United States Patent 12,491,220 (COMPOSITIONS CONTAINING INDOLE-DERIVED METABOLITES AND METHODS OF USE THEREOF) - sequence listing, part 2

SEQ ID NO: 9 - DNA, 4183453 bp, Bacillus licheniformis (residues 1-2,091,727 of 4,183,453)
  source 1..4183453: mol_type = genomic DNA
aagtctttttacgaggtttttagatatgtgtacttatcgtattgatcaatgcttttgttaatcttgcgcaaggagtcctttgtttctctgatttcattctctagccgccaaagcagttgttttaattcttcaatttgttgcttttccaccggttccacactccttttggaagatcaatcaatttgtgtatagtgaacgagtcataggtatttgatctgttaatacaagtttaaagggatttggtttctttttcaccgaaaagttgcatataaatttatgcgttacaccgcaaactttaaatagaccataacacccattttacacaacttgcgattagttctcaaatcctaatgaaacataaaatttttgtttgtttttcaaggagtcaaataaagatcgcatataaacccctttatcatcgcaagttcagttgtgttttgttcgttttgcaaccttgagtctaaagtagtaactagcggggaatagaaaaacttgagtgttcacggaacgcagatcgggtatgcgccaccgaaaaacacgcaatagaccgacacgcatttcggcccttataaaaaaccatcccttcgccttacaccgcaaaaaccgcaatttgacccgtaaaaattgaaaagaggtgttcatattgcttcctcctcattgcttttggatgcatccatatcaacacgtcagctgccggcaggtctatcccgaagttcaagtcagcgccttattgcgctcggcaaaagaagcggagagcttgatggctgacggacagagaattttaagcaggctttcagcctcgcgtactttggcccagcaaatcatgacggctgcccaaagcaaccaaaaaaataacgtgctggccgcgctcaggcaaaccggcgtccgcagccagcttgatgcctcattcgatcccgacggcattcgcatcatgctcatcagcccccgcagcagactattcctgctattgcgttggtcttagcgcaaaaaaaattccggtccctaagaaggagccggaatttttttataagagcttttgacaccaatcaacagcttcaagatagcactggtacgcttcatctttagttaagccttctgtctccggtgtgttgtcttcccattcgtttcgttcgatcgattttgcaagccgcaagatttttcggtaatcattttcttttccgagcagcgcctggcccacttcgtctgtcagcggcagttcgctgacgacttccgttagttctttgtgcagcagtgtatcgataaatgaaaacatgcctgtcagcatataagaagccggctgagggcggttcgttttttttgccagcaattcgcaaagcttcgcgcggatcagcgaaatcttgacgacttcgttcttgctggagttttgctttttcgttaaatccttaaatgagaggatgaagatccaccttttgatttctttaaatccgagaagcacgatagcctggcggatgcttttaatcttttggatcggccggttggctggagaattcaacagcttcagcagctggtaagaaagcgacaaatcgcgctctataatatttgtgacgttttcaatatcaggctgatcttcgcttaattcatgcagcagctcataataagcgtggaaatgatatgtaatgtcctgaccgtcaatcacgacaggctcgctgaagaaatagccttgaaacagatgaaatccgtcttttacagcctgctcatattcttttcgcgtctccactttttcagcgaggaacgtcaggcggtggttacggcatgatcgaaggatgctctgtctttcctgctgcgtcgttttgaaaaaatcgatcttcaaaatatcaatggatgccaaaagctgatggagcaagtccctcttcacgcgatgctttaaacaaaaatcatcgagtgcaatcgtgtagccgaggcttttcaaatgcctgcacctttcgataagctcaagggtaatcggcacatcttcaaggatttccacaacgagctgatccgggtcaaaatacgtcggcagccctgatgccaaaagaccctcggtaaaattcacgtaataccttttgccttctgtcaatttatcgattccaatgtttaaaaagctgttaatcattaattctgttgtcgcttgatcaccgtcaataccggaaaaaaagtttttctcgctttccctgtataaaagctcgtatgcgacaacttgttcttttctgttgaatattggctgtctggcaacgaataccctcattcttcttccccctagcgactgaggtgccttcgcttttaagtatatcaaataattgggcaaatcccgtctgctgtataaaaattcacccaaatttgaacttaatattgaaaaacagataatccccgaagaaattatctgtttcaatccccagttatgttaaaaactatcgtttacagagtcaaccttgatccagaccttttttcgccttgattttcgcttcgtgaatttgctgcatcttgttgttccagcaagcttcgcttaaatcgacaggatattcttcgggcttgctgatccgcttatactcttcccaaagcaaactgagattttcttgaacataccgcttaatatcctgaatgctcggattctcatagacaagctcgcctttttcaaagatcggctggtgaagatctttcgcatcaaaattcgtcacaaacttgctgataaacgtatgaacggggtgaaacatcttcagccgctcctgttcattgaccttttcatagtccaaagcgatataatcgccttctgaatgatggttcagctgattgatgattctgtacacctttttcaagcctggagtcgtcactttttccggattcgaagaaattttaatcgtgtctgccatctttccgtcttcttcgatcgaaacaagtttgtaaaccgcgccgagagccggctggtcgtaagcggtaatcagctttgtgcccacgccccagacgtcgatttttgcaccctgggctttaaggttcataatcgtgtactcatcaagatcgcttgatgcaacaacttttgtatctgtaaatccggcttcatccagcatggctctcgctttcttcgacaaataggcgaggtctccgctgtccaggcggattcccgaaaattcaatttgatcgccgaattcctttgctactttgatcgcatttggaatgccggaacgcaccgtatcatatgtatcgaccaaaaagacacattttttatgggtttccgcatattttttaaatgccgtgtactcatcgcgataggcctgtacaagcgcatgggcgtgcgtgcctgataccggaatgtcaaaccgcttgccggcgcggacattgcttgtcgcgtcgaatccgccgataatcgcggctcttgctccccacatcgccgcgtccatttcatgcgcgcgccttgttccaaattcaagcgccgtctcttctccgatcacacttttgattctcgccgcttttgtggcaatcaatgtttggtaattcacaatgttgagcagagccgtctcaatcagctgcgcttcagccaaaggcgcttcgatcctcatgatcggttcgttgccaaacacgatttcgccttcctgcatagaataaagcgaaccggtgaatctcatatcttttaaaaagccgagaaagtcatctttaaagcccagctcttcttttaaataaactaaatcgctttcagtaaatctgaaatcccgcaaaaattcaatcgctttttcaagaccggcaaaaacggcaaaaccgctgtcaaaagggagctttctgaaaaacagttcaaatacggctttcttttgatcaatgccgtcgcgccaatacgtttccgccatattaatttgatataggtctgtgtgtagtgctagactgtcgtctgtaaaacggtgttccaaccttcatttctccttcctcaatctgacactgaggctcccagggtgtttgcaaaatgagaaagagcccagtcgtgtccgtccgggttaaagctagccactgcgttttgatgaatgacaagattaaaccctttattataagcatctactgcggtatggagcacgcatatatctgtgcatacgccaacaaggtgcagttcttgaatatccctttcacgaagcttcagctcgaggtttgtcccggcaaaagcagagtaccttgttttttccatgtaatagacattctgatcgtgttcgtgttttcgataaagcttttcaagcttcccgtataaatcctgtcctgatgtaccttttatattatgcggaggaaacaaacgggtttccggatgaagcgtatcgccggcctcgtgtgaatcgactgcaaatacgacataatcgccgttttgaataaacgtatccgcgagacgcgccacggcgtcttcgattttgcggccgggttccccgcacgtcagcttaccgtcagctgcgacaaagtcattcgtataatctatacatataagagcttttttcattgccgccctccccgccttttgtatgataggtaacattataacttatctaaacggacaagtgaatggcgaatcaatcgaatatggctgtcaagccgcgccagcagcggttttttctttttcagaaaaaaacaaaaaccacgggttcgggaccgccttgcggaaggcgcgtgcgaaaacccgcacctcatctcttgtttaaaaccgactgctcaaagatatcgtcctgaacataaatcgattctttctctacggcctcacgcgccgcgagaacaagtccaaggggagtgtccgattgctgatcggacacgatcgaaaaagggacgccttgcttattggactccttgatgtaaggagataaatgagagtagccgatttcgccgttaagcaataatgttgcatccgcttttgagccaagcgcatcgatgacttcccggtatgccttcggacgcagcacttgtcctttagtcaatgcgatgatgaccctttccctcagcgagcctaaaaacagtctgcgttcatccggcttcgtttcgcgtggtccgtacattccctgctgtaaatattgatccaatgattggtcgctcacgtcttagaccctccagttttatcctgctggcagcgttttttaagctgcatttttttatcagtatgcccacgaaaacagcgggcatgagcccgtgctacatttcggtcacccattgtacgatctttttggacagctcctcggccgcatccgactcagccactttcgacaatgaccggtcaagcttttcggcgagttctgctttttcttcctcataggaaatcagcgtgctccactccagttgcggcacagccacaagcgtatgaaattcctttttattttcatggaggtaaacgtctgtgatcatctgatcttcgtttaagatgtttgccttcctgattttcatctttgtcacctgccttatctatcttttttcccattatactataaaaaagaaacagcctctttaaaagaggctgtcacaggttcaatgactgggaaccgtccatcacatccgcatctgtgaaggtcgttttattgatatcgttatgaatcaatccgtagtcccctgtttgaaatgtgcccgctcctcctccggaggaatccgtgcacttcggggaaatcgcaaacacatctccaaaaaaggctgcgctgtcatcaacgactcgcctgataaaaatcggtccgacaattgccggcattttcacacctccgccatttaatttattagcatcatatgtgaaaatgggcaaaacgttcagacttcaggattttccgccgtttcttttttatacctctgccttaaacggacaaggcggacgatattcaatgtaaaagccttgagcagggcataagccggaacggccaggatcatgccgagaatgcctccgaagcttccggcgccgattaataaaaggatgatcgtcagcggatgcgtattcaagcggcggccgataatcagcggcgacagcagattcccgtctgtctgctgaacggcaacgacgatgatcagcgcgatcaatgctttcgtcggcgagtcgagaaatgcgataatgacggccggcgccgctccaagaaacggtccgacatatggaataatattcgtcacggcaatgatcaacccgagaatcagcgcgtatttcacaccggcgatccaaaaaccgatgaagcacgccgttccgacgaacagacaaacaatgagctgtccttgaatgtaagccgccagcgtctcgtacaaatccttaaaaatcttcagcccttcatttttatacttgtcaggcaggatcttgacagccaaattcgggaaacggtggccgtccttcagcatataaaacaggatgaacggcacggtaacagccgtgagcgcaatgttggtcacaacgccgaatacagaagtcaggctccctgtaatattttcaggcaggctcgtcaaatattcgccgattgagctttcgattttggcaaccgatacgaagtcctgattcattatccaagtgaaccactgcgaattcgacatttgcttaatgaaaatctggatctgtttcacataggaggggatgttgttgaacagatcggtaacctgctttgtaaatacaggaccgactgctgacaatacaaacccgatgaatgccacaaacaccaaatagatcagcagaatggacagcgttctcggcagctttttctcaagaagccgcacgatcggattgaatataaaatacaagattcccgcaattaaaatcggagtaaatagagtcgatgcaaatacgatgatcggttcgaaaagaaaagacacttttgtcgacacataaatgataagaagaaccaataaaatttgcagcgtccaaaaatgggtttttgattttaacaagctttgtttcctcccggcttttttcattaatctaaaaactactattcacactaacgtctgtcaactgttttccttccattcatacgaaaaagctttgacagggtttcatatttcagcgccttttgaataaaaaagattgacagctcctcctgttgtaattatcatgattacaacaggagggtggtttgatgaagatcagcagcagatttacgatagccgtacatatgttatccttgatgcacgtccgaagcgaccatttgacatcagagcaaatcgcagacagcgtcaataccaatccggtcatcatccgccaaatcagcagattgctgaaaaaagcgggcttgattgaagtaaagcgcggcacaggcggagcgcacttattacgggatgccggcgccatttctttgtatgatgtctataaagctgtcgaagttgtcggtgaaggcgaactgtttcacactcacgaaaaccccaatcctgattgctgggttggcgcgaatatccaccaggttcttgagcttgttttattaaaagcgcaaacagccatggagaatatactcaaagaaatgtctataaaggaattgactgatctgatcatccaaaaaaagaatgcttctcagtgaggcatgattttttcaactcgttgtaataactatacttacaacaagcatctggcactgtgtttttttcacctcgttgtaatattgttcattacaacggaataaaaggaggtggttccatgtgatcaacacaggcaaaatcggatttccatcacattaagggaggacttaacatgacgaatcatataaaagaaatcaactgggagcaaaacaccaactcttacattcagctcataccgaatattgagtacacaaaagtggaagacacttctttgacattacatttgctggtgtaccgcaatccaatggatgcgttatttaacaggaaaggcaatcaggaaacatacccgctgatcatttatttgcaagggtgcggatggggctggacaaaacaggatacatccgcctttatcccccaactggttccatttgtcgagcaaggatatgtcgtggcaagcgttcaatacagaggcagcggagaggcggtgtttccggctcagcttcatgatgtgaaaacagcagtccgctttttaaaagcaaatgccgcccgctataacatcgatcctgatagagtcggagtctggggggattcttcaggcggccatttggctcttttgcttggattgaccgaaggaattgaagaatttgaaggcccggacgaataccgtcatgtatcgagcaaagtcgatgcggttgcggactggttcggtccggtcgaccttctgtccatgagcaagtatccgtccatcttcgatcatgattcacccaattcaccggaatccaagctgatcggcggagctgttcaagaaaacagagtacaggcgaaacaagcgagtccgataagctatgttcacagggaagcgcctcccattctgattatgcacggggatcaggacgatgtcgtcccttatcaacaaagcgtccaattgtttgaagccttaataaaagaaggccatgatgcccttatgtataaaataaacggggccggacataacggttttacccaggctcataccctggacatcgtcaaatcgttcttccgcaaacatttaaagcctggaaaagcctgaacattgaaggccggatatccggcctatcagtgtatattcctctcttttatgaatattttctaaatttttttcagtatatcggtataaagttcaccttcagaaaataagatgaaaacgcttacaaataaaccatgaggtgaacaacgatgaaaaaactggtgctgctcatgcttgttttgctgctcgtgtatccgcatgtatcgaaagcgggaggatttaaaggaggaggcggcaatccgggctactggttcgcgggagaccctgtagaacatcccgatcccgcaaaaccgccgattgtattcgtccatggattaaacggctcttcaagcgcttggtttgacgaaaacgacatggcggaacaggcctggaaaaacgggtatgacgcggcttttatcgatctccaccccgataaagacatgcaggacaacggagcgatgctggccgccaaactgcgcgaaatctaccagtatttcggccgcaaggtgattctcgtttcctacagcaaaggcggaattgacagtcagtcggctcttattcatcacaacgcataccattatgtcgagcgggtgattacactcggaaccccccatcacggctcacagctggcagaccttgcctacagcaactgggcaggatggctagccgatattttaggccagaaaaatgacgccgtttattcactccagacagggtttatgaaatcgttccgcgaccagaccgacaatcatcccaatcgattgaaaaccaaatattttaccctggcaggcaataaaatcggcgggttcggcagcgctttatttttcgggggcgtctatttaaacatgtttggcgaaaatgacggagccgtcactgaaaaaaatgcgagactcccttacgccacaaacctggatacagggaagtgggatcacttctcaattattaaaggaaacctcacgtttcctgtattcatgcctttactgacgattcaggcaaatgcaaatgaaactgcggccaccaaagaaaacttatcgtaccctttcatcagagggggggaaaatcatggattgagagaagaggagtttgccgttgaaaaaggcgtcaaggagataaccgttcactggctgagcaatcattcctcgggaaatatcaaattgacagatccacgcggcaagccgttcaaagatttttcaatcgcaaagacggcggatgtttttgaaggggggttcgtccattccgctgccatcaaaaatcccgcggcaggcacttggaagatcgcatcatccgtcaaacaaaaagaggcgtttttgttcattgtgactttcgattctcctctaaaccagcaaatcaaaaacgcagtcaccagagaatcgtcaaaccttgcgaatgttaaggcgtccgtccgctcgatccgctacgaaaacggaaaacaagccgagaaaaagtcgctgaaacctgcttctatcaatgcgctgcaaaacagcctgtcattcaaaaaagccggcatgtactcggtgacgatagacctttcaggaaaaacggcagacaactcgccgtttaacaggacgatcatccgctctatttatgtaaatgacaaaggggaaaagtttgaaaacagccctttgtccgattaaaccgttcttttcatgggagataaggattcatcgaccatgcggtcaagcttccggattttttcaagcgccagcttatgatcgattttgcggtaatggtggtttccgcccggctcttcgtccagctcatccgcttttttgacgatttgctgcagcttgtttttatcaaggtccccttctggcaaataggaatccgtatgaagcagaatcgccaaagcaatctctttggccgctttccgatcttcgccgaggcggatgagaagcttgtgggcgcgctcggctccctttattgcgtgaatgtcgttttgcttgtatttttcataatcccattctccgtcggtgtaccattcataatggccgatatcgtgcagcaatgccgcttttgtcgcgatatcgggatctactccagctcgcaccgccaggcggtatgcgtgataggcgcaggctacagcatgagctacaccggaacgagttaaatatttttgtgcgattggatgggtgaatacatccattaaagttacgtttctcatgtaaacccctcctttatatatttttagaatcctaacatattttcatgcaaatctcaattgatctggcacatcatattcaaaattgataaataaaaaacaagcacaatcgattcgatgtgcttgtttttttattttttacaaaaactctttaatatcatacactctgccgttttcaaagtcggtctcaagcaggtcgagcagaatgccggccacataagaggtgcttctcagctttccttctgtttgataggttttgaatcgttcaatttcatgaaaatcttttttcgatgatgaacggataacctcttgcatgccggtatccatgatcccgggggagaaagaaatcatcttcaccggatcagactcatcttcctgttcaaagccgaatgttttcgtgaacatatcgagccccgcttttgagctgcagtaggcgctccatcctttataagggtttttggccgcgcctgatgatatattgacaatcgattttttgcctttatatggcttgagccatttggtaaacagctggctgagcatcaccggcgctaacaaattcaagtcataatgcagcctcagttcttccggttcagcttcgccggcgcgcttgatcggcgtcaccattcccgcattattgatcaaggtgatcgaagcaaaatcatgggcttggacagaatctgagaattgccgaaaccacttttctgtttcggcgagctgcgccagatcggcctcatgctggatcagcctgtcatgactgatatcagacttggtccttgaaacagcatgaacaatatggcctttttgcaaaagcccttcggccatcgcggcgccaagcccttttgacgctccggtaacaatggataaatgcatacggcgtccctccttatccattattgtactgattcatcagcccgcttctcaagtgctgcggttttctgcgctaagaacagccaaccaaaagacagccgcaccgacagcaccttacagaacctcggacttttcattgctgagcgctcttattttttctgctgcccgctgactttcggaatcaaaaagaacagaccggcgatgcaaagaaggatcagcagaccgtatagaatgggcaggaagatggattgccggttttccgcagagtcatcttcccttcccgataaggacggatttgccgagaatgacaggtcaagctgctttagctttgaagccacggaattgctttcattcgtgaagcttccggacaggcttttcagcttttcgatagcatcttcttttttcgaatctgtaaatgagaattccttcagttcttctggaattgatatttcctctttgtattccgcctcttcttcctgaaggtagtccgtctcgattttaatatcctgcttttcgtactcgtttggctttacatcgactttatcggtttcctccgccttcgcgatcggagtgaaaagaaagaaggagagcatgactgccatgatccccttctttccccatttcgcattacgcatcatggtcagtctcgctttcttctgttcttgattttgcaaaatcgacaataaaaggaacagcaattgcgatgatcgtgattaaaattaatgctccgattccgagtgcaaactggcttccagttccgtactgaatcgacatatatacggttgataccggattgttaaagctgaagttcggcatcgccaggtcaagcagcggcgctacatagaacagcaccatggcggctgtcgcgattccgcctgcgatcgatcccagcataaacgccgtccggataatggctgaacttgcgacaagcagcaagatcgtaaagaccgaccacatgacggcctgatcgtctgcgagtgagtaaatgttcaaaccgaacaggctgatcatcagtccgacaatgatattcaaaatgccgaacagcgcgcccctgactaagagcggagcattttgataatggtggctgaaatatccgatcagcaagctggaaagcatcacaatcacgagaatgacgaccggcggtacgttttgcgcttttgactctggaacatccccgctgattttcaccggacttgccagatgatcgtatacatatccgtcgtttcctccgaacgcatttccgagaatgccgtatacgtctccgcggataagctttgtcgtcgcgacattttgaccccagtttgaattcagggtatccgcttttttctgaacatcgtttacactttcctgaatattgctcgtgtactcgatgacgcctgattgcgtttccgacaaggaaccgagcatgttggacagctgcaaaatgtcatttccaagcgtatcctgcatgctgatgaccatcgttccatctgtcgcatctccctgcatgactgctgttccggcgccttccggattgcgcagctgttcagatacggcatttgctctgtctgagatgttgctgagctcatttagcgtttctgtttgcttttcatcaatgaatgcgccgtaactgtcaacaaaatctgtcatgccggtagtatatgcttctatatcttcgtttgtcgccagcatgttgttcttgagatttttccattttgtggtttcgttttcaccgactctgagaactgtatcaactttatttttgctattttgaagcaatccatcttcaagctctgtccctgctttgtactttccagtaacagcaacatgataaaccgatagtagattatagtaatccattagttgattaatgtttctattgacaaaagattgattgtcaaaagcccgtttcacttcagggctgatatcattctcataatacacctttaaatcttcttcgagcttaattattttaccatatattttttgaaaatccttatctctttcttcaatcagtttttgttttaaatcttcaactcgttcatttaattcatcaacttttttattcagtttttctactttttcatctaaattatcaatttttttcttaagctcttcattatgctcttttgttttttgatcaatgttagatttcacaccttctatgttagcagatatggtgcttaattcttttttcaattcttcaagattactgccgtcttgttcatcgggattttcttcagctggaggtggatcctccttatttgtatcatcaacattgtttccgttgtccgcctgctgttcattttcctcagaatttactgtgttgtcattttcacctgtttgtcctgtatctactggatctgtcgaagtattatcttctgtcgttccatcattctcaccaggtgaaggggattcaggctcttctttatttggaacctcaatgttattagacaattcctctaattcttttgatattttctcaagctcagttgtttcatcatccaaatttatttcgatattcgtattatcatcttcgtcggaatcatcttctccatcatttccagggtcttcagctatcggtgtgtcatcaaattcgaacaatttttgtcgatactctaggatatgcgactgagattcaatgttctttatgtttagttgtctagcatcagctttataattggaaatcagctcgctctggatcgtgcttatctgaccaagctgctgttctggcacttctacataacgatatttcgccagattctcaagcgaacttccagcaaggctaaactggttttgcaaaccgctgagcgacattgccatgccattcatttgttcgctgaagcggctttgggcgctggcttgcttttctttgatagatgttaggccgtcttgaatttgtttttcactgtccgcctgggccgattgaagcagctccgactgcttctcttgatattgtttgtattgattgacgttgtcgacgaagctgtccaattgttttttggattcttcgacgcttgcgttgcgttcttttgatgtgccttctgtttcattgatcgattctttcagtctgtcgatcatctctttttgtctttctacttcgccagctaaattgttggagctcggcttgtaaaaattgtacatcgcgttttggaactccgactctttgtttacgatgctgtcaaactcttttctgacctttttgactccctgtttgacaaagcgccagtacagggaagacattttcttgctcaccgttttttgcgcgtcctgaagctcgcgctggactttttccttgttgacggcgtcgagctggtcctgaattttgaattccagctccgctttttgcggacgctcatggttgtagcttaaaatgttttgcgaaaagtccgacggaatgtagacaatcgcatcgtattgcttctccgcaagtccgctttctgctgcgctccggttgacgaccgtccatttataatccggacggtcaaccagggaagccgagatttcgtttcccagcagcgcatcttgatcaacggttccgtcatctttcaaaacgccggtatcctcattgacaacggcgatttcccttgtcgcgttcgatacctttttcgtcgggttctcaccgatgaaatgaaaaaacaggacgggcagcaagatgatcgtgacgatggcgctgataattttcagcgtgcttttttgttgttccgtcatttcgctttcttcctttctacagcacataaaggaatttgaattttcctctctttgccgttttcaacgatatagccaaagcccggcagaatttccggctcctggcgttcatatgggagctgaatcaagttctgctcggattttttcatcaatagcatcgcgtgtctgacctgcttgacttcgcttgtcagcgaatcatagccttttgtgaactcgctgtgatttccggcaggtataaagtggaaacctaaatgggcgtaagatttcatgaacatcgccattttgtcctgaatcgatgcgtcgatcgtctgctggaaccgtgaaattccgtcgacaataaagaccatcggtgagaaatcaaggttggcgatttctccttgtttaacggcttccaaatacatcgcttcccttgtccggcaaatttcttccgtctcagcgagccagagcagaatgtcgtcttttgtttctagatagctgatttgatcctctgtcgcatattgagaaagccctctgtctatcgaatcaaacacggcgatttttttcgtgtcatggtcaagcaggtgctcgagcatgatcttgatgacgtttgtttttccgcgctgcgtctgacccataatgaggcagtgcttatttttctcaagattaaagtatacgggttcgacagtttcttcatcgagtcccattggaataaggcctctttcaggctgaagcggataatctctcacaaactgtgtgacggaaagctcgagcggcagcatcggcacaggcgccggctttctcatgccttccgagcgttctgcgatcgcctgaatgtcggctttgatcccttcaaacagctcgatatcgttgtccgcttccacaggcataaacatttgtgcgaagtattggttttctttattgataataacgcgtccagggatcggttcaaggctgaattccggccttccgataatcgaatatgcttcagactgatccatcagatagtggacaaccctcgttttcaggttgttcaagagcgactgtctgattgcattgacccttgtcgcggtcaggattaaataaattccaagcgactggccgtctcgtgaaaactggataaattcgctttcgagttcatgcatttcgtctttaatgatgtcaaagttgtcgaccgttatgaaaataaacggcagcttttcctcattcagcgcattgtacatcttgatatggctgatttcttttgcacggaagagatttttcctgtgctcgatttccgccttgatccggaccataaatttctcgatttttctcgtttggtccatcaggaaataatccgcggtgtgcggaagccttgcaagcggaagcagcgttccgttgccaaagtcgaaaatgtagtaatgcaattcttccggcgtatactgttcggcaaagctcatcatgaacgtcgtggctgtcagggattttccgtagcctgacgagccgacgatgccgatattgccgtcttccatcatgcggtagctgatcggctcctggctttgcttttcaggttcatcgatataggcaaagttaaaggcatcggcttcctccgacggatagcgcgttttcggtatgcgttcttcaagcggcggcagccaagggctcgggagcttctcgattcccatctccgcttgaatccgttcaatttgttcgacgactgccgaaatttccgtcacagcctcttttttcgcagcgcgatcagcatcaacatctgataaaggaattaatccggtatctgtgacgatcgccacttcatcctctgtgccatagccgtcctccatgtaaggggctccgctccatgcagactggaacagttcatacacctcgttgttgccgacttgcaaatagccgcggcccgttaccgtgatggtagccgcatccccgtttttgaggatctctttactgtcattcgcatcctgcaccttcaaggcgaccttgaatctggagttgctccaaatctggtcatcgatgatgccgcccggtttttgcgtcgccaagattaagtgcaccccgaggcttcgcccgatccttgccgcactgacaagctcgcggataaattccggttcttcgcttttcagctcggcaaattcgtctgaaattaagaaaaggtgcggcatcgccgttttcgcttttttctgtttgtaaagctttgtatagtcgttgatatggttcactttgtactgatcaaagagccgctgccttttcttcagctcgctcttaatggacgcaagcgcccggttgctgaagttcttgctgccttcaatgttagtaatcgttccgagcaaatgcggaatgttccggaacggctgcgccattccgccccctttgtagtcgattagcaaaaatgcgacttcatgcgggtgaaagtgaactgccaaagacaaaatataagtctgcaaaaattcacttttacccgaaccggtcgttccggcaagcagcccgtgggggccgtgcgccttttcgtgaaggtttaaataaacaatgtcgtcttttcctttatagccgatcggcacggccaaagatttggccgattcgcttgtcatccatttttgttcgatgccgatgtcatcgacttccttcacttggaacagttcgagaaacgatacggtatcaggaatcgaattcgtcatgcccgtctggtggtcaagcgttctcagcgtccgggaaaactgttcgttgtcttccctgttgtggtgatccagctgaaacgggatctggacggctttcttttgcttgatcagaatgtcgccttcctgttcagtaatataacgaacaagggtatgaatgttttcggacaggctttcttttgtctctgccgccacgattgtcgacactccgaggtgtttctgcttgccttccaaatattctaaaatgacgtgttctgcgatgagctgctgatttgtgatgataaacacaaagtgcggcttaaacaaagtcttctttttgttttcatctaaatcccgttctctcaaaatctcatatatgcttgaaaggagctgatctctcgtctgttcgttgtaaataaaccctttcgcataaatatgaggcatctgaaaatgcgggagccacttcatccattcccattcttgatactcggcttcgtcaaaaataaagacaaagcgcaagtcatgatagctgtggaaaaatgcgagctggccgacaagctgatgaatttcatttttgacgacggacaattttccgacgacgcccatcgggccttcggcaagattcacagtgatcggcgcatttttcagctctctgtagacctcttccattttttgcgtttgttcaaggagatggtctgtatcgcggttggccaaatctccgccgttcaaattgatttggtacgaagatgcaacatttcccgttccaaggcggatttgcagaaaatcggcgctttcaatcgatttttcccaaattcgtccgctgatctcctttgttaaatatttcattctctcaaatgtaggaaaatggaaatcaagtacgaacttttgtctttctgcaagttcatgcagctctttctttttgttttcaaggtaaagggtatagacccgctctcttttttcttctctttttttacgctgatttttgtcgcggaagtactgcacggttgacgtaatcagcgtcatcataaacatcgcaagggaaacgatgataaagatcccccgcggctgaatgagcgccacgatccccatgacgatcagcatgacgagcggaggcagaatcatcagccataggcctctgttgtctccgtcgctttcctgtgccgggaagctgaaggatactttttcatccggcaggtcgtaaatcattctcggcggcctgcggtattgcggatatttattttttgtctcggagctcggcttaagaatgttctccaaagacgtatcaaacttcccgaatccctcgatttccaagaggtcgtcttcaacgatgcgaagaatattcagtccaaatgcgatttcgtctccattttgcacggagacaggggcggacacttcttctccgttcaaataaattttcgcgtcattcggcaggacattccattgcccgtcgaggcggatgaaagagaacgtacctttttctccaaagaatgaatccgtttcattgaaataaacatccgcttcttgatcgagggaagaaatgacgatttcctgtctctctcccaaatagtaggcaggaacgctgtcggcttcttcggctaaaaagagcgtcagctgttcagcgccgctttggacggacgcctttccgccaagctttaaagaagagaccgtctcccctcccagctgcacgttcaaagcgtctgagtccttctgcttttccagtgtcaccgggcctttttcaaatgaaaaatgcttaatcgtgacagaatgtttcaaatccggcccgatggtgagcgtgcggctgttctgatcatccagttttattttttgatagtttttatgataaaaaatccataacagactcatttctccgcctcctgccaacaacaggtgttttcgcttttatttgtcatcttttttctttttgtcttccttttctttattttcttttttcgcctgttccttctcggccttctccgtttcagcctttgcggcctctacgtccgcctggttttgctcggtgtttgcctgctggttttcttcagttttggctttctgttcatccgctgtccgcttcaattcttcaagttctttttcgagcggatccagctgtttctgccgctcatcactggacaatttatcatcggctttaatgtcatctgtgtatttcataagtgccaacatgatctgtgcattgttttccagcttacgggccgtctcaagcgcttctttattggcgccgcgtccgatctgaatccagtaaaggaaattattcggatcgacttgaagcgtcaggctcttcatggcatcttcctgtaaatcggcttccttcagtacattgtcaacgatgatatacgaataagccagctgatactgaacagaatcaggcatctcatcggcatcatatttatcaagcgtactgatgactttgctgtactgtttatttaagaagtagcggttgctttcgataaacgcctgctgtttcggctgcgcgaagaataatgaatagaaggaaaataaaacagccggtattaagcataaaattagtcctaaccctatgtacctttgaatcttccatttcttcttcggaagatggacaagcattttttcttcggcatccagttcatcgatcctcttttgaatgacggctttcaaatcgccgtatgtcccgcttgtgatgatgtcttttacctgatctgaaaatttgatggtttcgctgtattttaaatactcttcaaaagaaaattgcccgtcgacagcaagcgccgcggcggctttcacttcattgaaaagtctttcttcgtcgtgttcatatggcggaatgctttctttcactccataatgtaaaaatttaggcgtcaatcctttgtcaaaaacaatgttttcaggcgcagcgatcaggtgcagccttttaattgaatgttcttcaacggctttcacgagctggtacgcgaatagccacttgctttttttatttttcccttttatataacgaaattctttatattcggaaggaggctgaatcataatttggacttcatcatcggtcatgacggcttctttattaaaggaaggatcgacttctttaatgacgtttgcttccaagccgttcacaagattgatcttctctctttgaaaacgaaagatatatgtaccgtcttctttcgtcatgacggcctctaattggtcttcgagatacgttttctttttctctgccattcatccagatcctttcataatatttccagacggtcacctgtcgtaattccgcattgcgataatgtatattcgcctgaaaaaacggcatctttatttgtcacccttacccagtagccttcccggggaggcaccggtatgcttttggcttgccacgcaatgtcgactacctttttaacagaatggtaatccgacagtctgaggtcaaagacgctgccgtcgtaatgttttaaatcgatggtaatgtcaacatacaccagttcatcacctctcaatagaaaaagcgccgtcatcttcttttgaattaggcgcttctctcattcttctaatctgtaaattagccgcggatttggctagcgatgtcttggtcagtgctttcaagagtgttagcagtctgatgaagctgtttagaaacgtcgcttagaagttcagccattttaataaaagaaggtcttagctcttggtattgctctgagaacgcacggcttgattcaccttcccacatatcttgaagctggttgatcatttgatcaagacgctgattgacctgctcagtcacatctccgctttctttttgatatctgtcagccatttgccgcagttcagccggcgtaacacgaatgattcctgacatattccttatacctcctgcgctattcgccctagatatgggctaaataacttatttttttgaacgcttttattataaaaacaagattgaggcacagtcaaacaaatctgttgttattttacaaaatgagtctaaaggtttatcattcctctatttccacccagcaaaaattatagaaatctagtaaaaatatctcaattttcttctttcggaacattcgcatcaaaaagcatggttcaatgtgactatctgagactaaagcgtttccataggataaaggaaggattgcctatgcgcaaaaaagcccgcctctcttagaggcaggcttgtcttgatcagcccgctttcaagccggctgacttttgtttttccttattatagtggtgcaaaaagaaatcgtcagtttccgcccgaatgactttccataagagcacaagggcgatcaagttcgggatcatcattaatgcgtttgccgcgtcggcaaaagcccatacagtattcaggcttgcgactgcaccgtaatatgcagcaatgacataaacgacacgataaagcggcacccattttaaaccaactaaatattccagacatttttctccatatacataccaaccgacaatggttgagtagccaaagaaaatcaccgaaaacgtgacgatgtatttgcccgcggctcccagcgaagaagcaaacgcggcgtttgtcagcgcgccggcatcaagcgatgcatcgtgggcaacaccagaaagcagaccgcctgaaggatcccagaatcccgtgataatgaggacaagccccgtcatcgtacaaacgatcaatgtaacgatgaaagttcccgtcatcgcaaccaaagcggccttgacggggtgatcggatttcgcgtttcctgcgattaaagcagcggtaccaagaccagcttcatttgaaaagattcctttcgacattccgtttctgatcgcctcagagacgaccacgccagtaaagccccccgcggctgacaccgggttgaaggcgtgataaaaaatcagctggaacgccggaatgatttgatcataatgaaggaaaataatgatcagtgatccgccgatataaagtatcgccatgaccggcacaaaaatgctcgcaaccgtgctgacacgctgaaaaccgccgaagatgatcgcagccgtcaataccgcgagcacaaggccgatgatccagccgggaatcccgaagctctgtgtaacgacttccgaaatcgtgttggactggacggaatccccgattccaaaagaggcaagcacacctgacaatgcaaataaaacggcaagcggcttccacttcttcccgagccctttttcgacatagtacatcggcccgcccgaatattcgccccgctcatttttgacgcggtatttcgtggcgagcaatgcttcgctgtattttgtagccatccctaaaagaccgacgagccacatccaaaacaaagcccccggacctccaaccgtaatcgccgtggctacaccggcaatatttccatttccgatcgttccggcaagcgttgtcatcagcgccttgaaattgctgacatcaccgtctgctccggctgattctttttctttcccgaatgcaagtttgaatgcatatatcaatcttttaaattgaagcccccgcaggatgaacgtcagaaataaaccggttcccgcaagcataacgatgcccgggactccccataaaaagccgttgattttctctagaatcgccaatgttcctactcctcttatttcagaataattaaatttggtttaatacatcgccgtgtttatgaaaaataataaatcaccagcgacttttttgttgattttaacaaacaactatattcataataaaagtaagatgggtatatgtcaaaattttttcatgcaaacataaaaagtaggggttttttatgaacaatcgaaacaatccttttaaatatcaatatgaccgtttagaagatgtggcagatcatatcagcgaggtgctggactgtccgattacgatagaagacatcaaccaccgcctccttgcttacagcacccacagcgactacacggacccggcgagaacgtcaacaatcatcggaaggcgcgttccggaaaaagtcatcaacaagctttggaaggatggaacgattcccgccttgatgaaaaccgacgaaccgatcagggtcgaacaaatcgatgaagtcggcctgtcgagccgcgtggcgatttcaatctggaaaaacagcgaggttatcggttttatctgggcgctggaaagccaaaaaacgctgtcggaagacgagcttcaccttttgaagctggccgcggattccgtaaagaacaagctgctgccttatcaggtccgaaaaagaaaaaatgaacagcgcagccaggaatttttctggaagctattgaccgggcacatttcggaagatcaggaaatctccgacggctttcaccagcttggcatcggagttccttcaacttattcggtcatcatcatccggctgaaagacgaaatcgaagaaaaaaccgaaaagcagctccattacttgctggaaacgacgcagcagctgcaaatccttctggctacaatcgactataatgagctgatcgtcctcgcttcgccaaaaacggggcaaaaagggcagccgttcaatgatttaaagcaatttgccgcgaatatacaaaagcaacttgaagagcgctataaactgaataactgcacgatcgcgatcggcggaatgtacagcttgatcacccttgtacaccagtcttatcaggaagcgctctcggcgctgaaggtcaaggagcgttttcccgatgagacaaggcacctcgtcagcttttcagagctcggcatctaccagtatctcgacgtgctcagcgaaaaacggaaacatgcaagctatccaaactattctttaatgcagcttgaagcatatgataaagagcaccactccaatcttgtcgagacgcttgaacaattcatcgaatgcgacagcaacgtcaacaccgccgcaaaaaagctgaacattcacgtcaacacgctgaattacaggctgaaacgcatcagcaaaatcgccgaaatcgatttaaaaaacatcaatgaaaaatttacgatttatcttgaaatcaagcttcgcaacatgcatttgtgaaattccacaaatgcatgtttttttatttttcgattcaaacaaagaaaattctaaaaagtcagtataaactaaagcaacagcatttttacagaaaaaggaggaatgatcggatgattatcggcgtaccgaaagaaatcaaaaacaatgaaaaccgtgttgctttgactcccggtgcggcttctcaattgatcgcggcaggacaccgcgtcatcgtggaaaaagacgcggggactggaagcgggtttgaaaatgaggattacgtctcagtgggagccgagatctcagaacaggcggaagccgtctgggaagcggctgaaatggtgatgaaagtcaaagagccgctccctgaagaatatccgtattttagagaaggtctcatcttgttcacctacctgcatttagccgcagagccttccttggctgaagcattaaagcagaaaggcgtgacagccatcgcctatgaaaccgtcagcaatggccgttcccttcctttgctgacgccgatgtctgaggtagccgggcggatggccgcccaaatcggcgcgcagttcctcgaaaagccgaaaggcggaaaaggcatattattggccggtgtacccggagtcgcgcgcgggaaagtgacgatcatcggcggaggcgttgtcggcacaaatgcggcaaaaatcgcggcgggcctcggagccgacgtgacgatgatcgatttaagcgcggatcgcctgcgccagcttgatgatcaattcggcaatcaaattaaaacattgatgtccaatccggtcaacatcgccgatgccgtagcggaagccgacctcctcatctgcgcggttctgatcccgggtgccaaagcgccgactttagtgacggaagagatggtcaaacagatgaaaccgggctctgtgattgttgacgtcgcaatcgatcaaggcggcatcgtcgagacggtggatcacatcacaacccacgacaatccgacctatgtcaaacacggagtcgtccattacgctgttgccaacatgcctggcgccgttccgcggacatctacagttgcgctgacgaatgtaacagttccgtatgcgcttgaaatcgcgaacaaaggcgcggaaaaagcgattcttgaaaaccctgcgctaaaagccggcgtcaacacagcaaacggccatattacttatgaagccgtagccagggacttaaactatggctacgttcccgcagagcttgcgatcgaaaattcgtcgtcagccgccggcgcatagcatcaaaaaaacagagcctcggaaaatatgcccgaagctctgtcttttttttatgattccgttttccggcgatcctgaatcaattttgccgcaattgcagaaacaggaaccgccccaaacaggacgattctccacagcgtccggtcagaggcatcgccgactgcggcaaacagtgccagaactgccgcagccgtcagcaataataaaacagcaaaagcctttttcttgaatgatgcaatgaaaagccaaaaacaggcgctcagcattaaaaatatgaacagctgtacgaaaaacatattcatcctccccgctaatcaaagctgtatctttcttctttccacggatttcccctaagatggtagccgtttttctcccaaaagcccggatggttttcctttgtaaactgaatgcccctcagccatttggcgcttttccaaaaatacaaatgcggcatcaccgctctgagcggaaagccgtgctccggcgtgagcggggcgccgttatgggaatgagccaaaagagacgaatccttcaaaaagtcttcgagcggaacattcgtcgtccagccttcctctgcatgcaagatgacaaatctggcttccggaagcggctttactctttcagcgatctcctttgtcttgatcccttcccaaacattatcgagcttggaccagcctgttacacaatgaatgtcattggacacttcgctttgcggcatctcatgaagatcatccaacgtcagcaggagcggctgttcgacaagtccgtaaatttgcaaattccattttgacaggtcttcgtattccggaacatgtcctgcatgaagaacaggaaaagatgttgtgacattttggtttggaggcaccctgtcggacttgtgcggttttgttttcccaaaaaacacgaaagaaccccctttgttaactcgaataaaaaatggttgacaaactattttgtgatctcttacgataaagttgtgtgaatcactgaggaggaacaaagatcatgaataataaaaaacttcgcgccggcgaaatggcgcttgtcggaatgtttgccgctctgatggggatcggcgctaatatcacttcgtttgccccgtttctgcaaatcggcggtattccgcttacgatgcagcctttcttctgtttgcttgccggacttttgctcggccgtaaattaggtgcgctgtccatgattgtctatgcgttagtcggctttattggcgctccggtattcgcttctttttcaggcggtatttccgttctttttaaaggaagcgcaggctttattctatcctatattcctgccgcatatgccgcgggctggatcacggacaaactatccgaaccgaaaacaggccactttttcgcagcctcattgatcggtacgctgatcatttatctgatcggcgtcaactatacgtatctcgctttttccacttggctcaatacaccgatgtcatattcagccgtttggaaaatgatggcctggttcttcgtgaaagacttggcattctccgttctgctcgccgcgctcgcctcaaaggttttccgggcggttcaaaaaggcgcaggcttcagaagaaatccgactttttaataaagagagcccgtggtgcggttctcattttattttaacaaacatagaaaaaaattcccctcgttttgaggggaatttttttaaagaacaatcgccgcgatccagccgaacaaaatcagcggaatattatagaagatgaatgtcggaacacaggtgtcccaaatgtggtggtgctgtccgtctgcatttaagccggatgtcggtccaagcgtgctgtcgctcgcaggtgaaccggcgtctccgagagctgcggccgtcccgataatggcgattgtcgccatcgggctgaagccaagctgcatgcaaagcggaacaaatatcgttgcgataattggaatcgtcgcaaatgaggaaccgatccccattgtgatcaataagccgacaaccagcatcagcaatgcgccgagcacctgattattgctgatgaaacctgttgacgcttcaacaagcgctttgacatcgcccgttttttcaagcacattggcaaaaccggccgcggccagcatcacaaatccgataaacgccatcatgttcatgccgttagtgatcaattcgtccgcttcgccgcgcttcatcgctccgcttaaaaacaagaccgccaaaccgctgagcgcgccgaagatcattccgtcgacgtctaagctctgagacaaatagagctgtacgcttaatgatacagcgatggccaaaacggcaatcgaaaggcttttcttcgtataggacgccgacttttgaccggcgatttccttcatttcatatgtgcggggtttgcggtacacaaaagcagcaacggccaaaccggcaatcatcccgacaatcggaatgatcatggcgattggaatatcagccaatgtgacagaaaggcctgcatctttcatattgtctttcaaaatcccctggaaaatctggccgaagccgacgggaagcaaaatatacggagctgtcaatccgaatgtcatcgcacacgcaatcaggcggcggtccacttgcagctcattcaaaattttcaataacggcggaattaaaacaggaataaatgcgatatgaaccggaacgacattttgagacatacaagaaataattaaaatcacgaagacgatcagcgcttttgaaagggttttgcgccttgtatcgccttctttgccgatcagcttgacagcagcttcaaccatggcatccggaagacccgttttcgtcaaagcgactgcaaaagcgccaaggagcgcgtagctgactgcgacggttgcgttgcctccgagtccttccgtaaatacgctgaccgtctggccgagaccgagaccgcccgtcagaccgccggcaagagcgcccacaatcagggctagaacgacattgacccgcagcaggcttaatataagcatcacaataacagcaatcacaactgcattcatatttgaaacctccgaacaaacactttagtttgctaatgtagtagataattaaagtaatgaacgtatattaccacatgttttatgaatgcgtcaatgagacatctgcgttttttccataaaaaaatccccttctagcaaaggggatgaaagactacaaatttcccgaaaaccgctcgacaaacgtgacaagcgttctcaccatcacgcccgttccgcctttcggtccaaagcatgagttttgagctgtcgttgccgttccggcgatgtcaaggtgaacccatggcgtctgctcggcgaattcgccgaggaacgttccggccataatcgcatggccttccctgcccggtgaattgttaagatcggccatttggctgttttttactctttttttgtctttttcagtaatcggaagctgccaaatcgcttctcccgcttcttcagccgcctgtctcacctgctgataaagcggatcatgatttgtcatcgctcccgtcgtttccgttcccagagctacgacgacgcctccggtcagtgtcgcgacatcgatcagcacggaagctccgtggtgcttcgcatatgtcagtccgtcagcgagcgccagccttccttcggcgtccgtattcaagatctcaatcgtcttgccgctcaaggaaacgatgacgtcgtccggcttcattgcgcttcccgaaatcatgttatcagtcgacggaatcacggcaagcacgttttgttccggcctcaattcgccgatcgcttccatcgctcccaaaacgctggcggctccgcccatatcggacttcatgccgacaatcccgctctttgtcttaatcgaatagcctccggtatcaaacgtaatccctttgccgactaaagcgatgacgtcatcccatgtttcttttccttgatatttcaagacgatcattttcggcggctcttctgatccttggttgaccgcgaggagaccgcccatcccgagctcttccatttcagccttttcaagaatttcacattcaaattcgtatttcgccgccaattcagcggcatatgacgcgagatccgccgctgtcagcatgttccccggcatgttcacgagggttctcgccgaattcgtcgcatttccgtacacctgtccgacatgcagactcgcctgaatctccttcaggtcatggtctgtcaaaacatagacgctttgcagacattgatcaggcacatttgatctgtgcttgtaatcctgcacttcatagcatgacagcatgcacgattcagccaatgcatgtgcggcgtcagcagctgggacttcttcggatacgaagctgtcgagcatgacggttaactcctgctttcgatctttgtgaatcagctgaacagcttcggcaaagcactgcttcgcatcctcgaaggtaaattccgcttcacggcccaatccgacgatataaatgcgtttgactccctgaagcgaaggggtaaatattttagacactttcgcttttttggaagatacatccccgtctttcagcagctgagaaagctggccgttcaaaaggcggtcgatttcttcagccttaccgtacagccggctttttttaaacagtccgattaaaagcgtttcttttttttcgaaatctttaaaggcataaaacatgcgttcacagctccttatcagcaaagtgagtaaaattaaaacaacaatgttataataggaaaaacattttttcccgatggggtttcatatcatatattttagcaaataactgcgtgcttttctgaattcatctctattttctttatagaaaggatgttctgcaaaatggaaatcctcacaaactttcctttgctggcgagctttgccgcgatctttttcgctcagtttatcaaggttcccatttactttgtcgtctcaaaaaaatgggattggcggcttgtcacaagcacgggcggaatgccgagttcacactcagcggccgtcacggcgctctcgaccggtgtagctcttgatcacgggatggattcttctttgttcgccgtttccgcaatatttgccgttattacgatgtttgatgcaaccggagtgagaagacatgccggagaacaagcaacagtgatcaaccggcttgtccgcgattttaaccgctttgtcaacgaagcgaaggatttccctaaaagccatcaggaagaaaaacagaaaaagctgaaggaactgctcggccatcagccgattgaagtgtttttcggcggcctgaccggcattgcactgacgctgcttctcgattatttattgatgtaaagcaaaaaaacgtttaagacgccaggtcttaaacgttttttcttattctttcgccattttatatttttgtctgaatacttgcatcgatttattttcattcagcttcaggagatcctcttcggtaatggtgccgtttccttttttaatgacataaacatcaagtgtttttttgccccattctttataaacatcctcaaccgtctcatagtacaaatcgagccggtttcccttaatggctgatccggtatccgcaacaaccccatagccgtagtccgggatgaacaatatcgtgccgatcggaaagaccgacgggtcggctgcaacggttgaatataaatctctttttactttgactcccgaatatgtaatcccgtaatcgggatgatgaggctgttttcccgttgattcagcccctgctgtatatccggtcgcggtgactttttgcttcggatacttgctccagtcaaacgcgtcttcaagcgatttcggtttgtttttaatttgttctgcggcagacagagacgtcttttccgctttttcttccggaagtgatttaaaggtgagcatcagctgtttcaaggacagatcgcgttcttttgcccagctggatatatcctgtgcctccacgcctgaaacggcaaagaaggtcgtcataaaagcaaggacaaacaaaactgtcatcaagaaacgccggaacatagtcatcacttttctcaattcttccactcctctcaccatctagttgtttccaagtggaaaaagaaatattcagatggcggaaaagttttgagaaaagtgaaaaaattaaccgcaaaaaaaaccctctcccttgaagaagaaggcttaaaacatttgatatcccctttttcgcagcgctttgatcgtaacgcccgacaacagggctccggccattccgctggctaaaatgatgatatcggcagcagccaaagaagccactctgtcaaaaaggccggaaaatgcctctcccggcgcctctacatagcgaatcagcttttctttattcacaatgaaaaggcatacaattggataaatgacagccatgatccatgacattctgagcagcatattcagcagaaaaccgatgccgaaaaacaggacgaaaaataagacaactgaaatgatgacaactggtaaactaatcaaagcctccacccccaattcacctcttttagtgtacattggggaaggaacttgagtcaatcattggaaagctgtgatgaacggtcttttcctgttcccttgcagttgctgcacgtttccgaaccgccgagcagaagctgaaaatagccttttcctgaacagaatgtacaggtagattcaagtcgatgggttgacgttgtcttcatcggatacacacctttttttcttaattttctgataatatatcatgaacgttgtcaataataaagtcagaaaatataacagatcatttgatgtaagcgcttaaaagcgaagctttctttctttttctttcgtttttgaagtttttagcctgaaataaaaagcctgcagaggaagctgcaggcttcagcgtgtcgacaaaccctcgttgtcagacctgctaagtcggtgctcatgaatagaggaaggatcggcggctaaccgcccaggcatcctgcctgaacgccgccgtcatcaccttctgtgaaagtctgatcagaaaaatttaaacttgccttttttcagaacaagtcccggcccgccgatcatgaaaagcgagcggttgtcgatgatttttttcatcatggacgccgtcgttcccgtcatctttctgccgaatgcgacgccgattgcatcgtgttcgccgagagaagcgacagagcctttgttatcaaatgagaacgtttccgtttctttgccgtgaatcagtgcggccagattgtttgcgcacgtttcgccttgctgcatggaaatctgcgcagtcggcggataaggcctttcggtttcttcatttatgattaaagagcagtctccgataacaaatatatcatcatggccttcaacgcgcaggtcaggtttaaccttcacacggccgcgcatgttttcaaagccggattcctcaatgatcgggttgccgcggacgcctgcggcccatacgacagtgcctgctttgatttcttcggtctgatcgtcttttccgacgatgattccgtcaggcgtgcattctttcacggccgtgccgattttgaattcaacgccttttccttcgaggtagttgaccgcataatcgacaagctccggttcaaagcccgggagaacagacggcgcggcttccacgcaaattaaacgaacctgctggcggtcgatatcgtattcgcggcacagctcaggaatgcggttggccatttcacctaaaaattcaatgcctgtaaaaccagctcccccgacaacgatcgtcaggcgttccgggcgcttctcggcttctgtgttatacgtcgcgaactgatattcaatgtgctcgcgaagctggcgggacgaattgatgtttgaaatagagaaagcatgctctttcaatcccgaaattccgaaagtttcagggacggagccgagcgccacgacaagatagtcgtaactaagctctcctgtttcaaggacgactttctttccttctttatcgattttctttaccgtatcctgaacgaaattgacacgggatgtattgatgacgtctttaatctgatagcggcatctgtcatgatgaagcgtacctgcgctcgcctcgtgcatccaggtcgtctcataatggtaattgtgcttgttgacaagcgtaatatccgcttcattgatgccgatttttttaacaagtctcgtaacggtcattaatccaccataacctgcacctaatactactacttttggcttattcaacggaatcacatccaccttttctgtattttactgctaagccggattaaaaatagcctttgggttatcttctgccggcttccggctttttatgaaaaaaagtttgtgaaacccttcactttagtttgccgaacaacggaatgtttttcggctgtgcgacgaaaaatattcacgaatcgttaacaatttgttcacaactacatcatagccgcttgcaattgctttttcaaggttaaatatgctctgacggtattattttccgcgcctaaaaaaacagacacgctcgtatttattttatgtgatatgatataattaagaacaattttcatttagggggcattattttcatgcgtgaagacacaaaagtatatgacatcacaattatcgggggcggccctgtcggcttgtttaccgcattttacggcggaatgcggcaagcgagcgtcaaaattattgaaagcctgccgcagctcggcggtcagctgtccgctttgtatcccgaaaaatacatatacgatgtagccgggttccctaaaatccgcgctcaggagctggtcgacaatttaaaagagcaaatggcgaaattcgatcagaccgtttgtttggaacaagccgtcgaaagcgttgaaaaacaagcagacggtattttcaaactcgtcaccaacaaagaaatccactattctaaaacggtgattattacagccggaaacggagcattccagccgagaaagctcgagcttgaatctgcggcacaattcgagaatgcaaaccttcattactttatagatgatctgaatcaatttgcgggcaagcgcgttgcggtattgggcggcggcgactccgccgtcgactgggcgctcatgctggaaccgatcgcaaaagaggtgtcaattattcatcgccgcgataaattccgcgcacacgagcacagcgtcgaaaacttgcgcaattctaaagtcaatgtattgacaccgtttgttccgaccgagctgatcggcagcgagcgaatcgaacagatcgtcattgaggaagtgaaaggcgagagaaaagaaatcatcgatgtcgacgatgtgatcgtcaacttcggttttgtttcatctctcggaccaatcaaaaactgggggcttgaaatcgagaaaaattcgatcgtcgtcaagtccacaatggaaacgaacatcgagggattctatgcagccggcgatatctgcacatatgaagggaaagtcaagctgattgcgagcggatttggtgaagcgccgaccgctgtcaacaatgcaaaagcttatatggatcctaaagcgcgtgtgcagccgctgcactctacaagcatgtttgaaaacaaataaaaatgaaaaggagcctgacaccggctccttttcattatatgatattcaaatatgagaagatcgttcccaatatcagcacaattgttaagatgccgacgactcccgccgcagtcaagacaatccggtccgtaattttctgtgattttggaagcggtttttcgcatccgcatgcctcgcagacttttgaatcgtacggcgtaagcccgccgcagcttctgcagttgattttttccatggttgaaccccttttctttactgggcttggacactaaataaacctgtccagtatagaataacaaattgacgaatagaatgtcttaagattcacaaaatattcttaaatgaactccaaaaaacccttgttaggaagtgacgatatgtcttactacaacaatcgcaatcaagagcctctgccaaaggaagatatcagtacgtgggaatgtacggctgaggactgcaacggatggatgagaaaaaatttcacgagcagcgaccgccctttatgccctctgtgcaacaaggaaatgataagcggaagccgctatatcacctctatcaccaacaacacgagcaatctgaatcgcatctttaaccagaaataaacacggttgtgttccggaagcccattgcaaaaaccttgctcaacactttgagcggggtggctgcattgctcctcttcgcgaagaagcagaaaaactatgctaaatctttcaccaatagaatctcatcccgaatcggaatgccgttatcagcgacaaagggaatttccggctttacttttcttgctttgtcaactgcgtttacatacaactcggccaaagtatagcccctcttttgataaaacataagcgcccgcatattatcgttcgtcgtgatcagtttaatcgatttacactgttttcgctttgaaacacgctccacttcttgtaaaaggagtgagccgatccctttgttttcgacaacactgtccaaagagacgacttcacattcgtttccagcgatgaagtacgtaatcaagcctttaatgtcgcttttttcatctgttacagcgaatccttccaattcatcgcagcggaatgttccgtgtgaattgaccatttccggacttccccaatgtgtatgaaaaaacgcggtaacgtccgcttttgacaaggcgtgcgttgatacgagtttcatttctttttcccccagaccataataaaacgccttttcatcacgatgaagcatcgagatgaaaggcgtttttttcattgcatatcgttgaccttatgtcagcactcttcaggcttccccgcattcgctgcggttctgaatgatgatccgcagccgcatgaagcgatggcgtttggattatcgatggtgaagcctccgcccatcatcgattgtttaaaatcaatgaccgtaccgttcatgatatccagactttcttggtctacaagcactgtgattccatgctggacgaattcattgtcgtcttcgtttttttcatgttcaaaacccatgccgtatgacaggccgctgcatccgccgccttttactccgattctcaaaaatgcgttctcctcttcatgctctttcatcatatccttgatatgaagagcagccgcttccgtaaccgtgaccgttttttcgctcatgagattacacctcctaaaagctcatgtgtacctttattataaagtcgcacgtccgatttctcaaacagaccgacttatgatataaaaaactcgccttcacataccgtttcagcgggtcccgtcatcatgacgcgtccgtcgtttttccaattaatgatcaaatcgccgccggcgagatggacggtaatgtccgtgtcccgtttggaatagccgttgagcaccgaactcactgtggctgcgcaggcgcctgttccgcaagcctgggtaattcctgatcccctttcccaaacgcggaaatggagttcattttcgttttcaacttcaacaaattctacattaaccccttccggaaacctttcatctttttcaatgagcggtcccatcgtcgtcagcggggctttttcaatatcgtctaaataaaagacgatgtggggattgcccatggatacagcggtacccttcatttcacggccgccgaatatcatcttttcattgatcgtctctgaaccctgttcaccccgcatcggcatatctgatttgagaagtcgcggttcgcccatatcgaccgtagccgatacaacttttccttcatccacctcaacctgagcctttaccaagcctgaaagggtttcaattaaaaaggacgtttcctctaccagtttatgttcatacgcgtattttgcaacgcagcgcaaaccgtttccgcagtttttgccttcagatccgtcgctgttgaaaatccgcattttaaccggcgctcgatctgaaggacagatcagaatcattccgtctgaaccgattccggtgtaaacggaagacactttgacggccaaatccgacaacagctcctcagggagatgttcttcaaactgattgacgtatatatagctgtttcctaagccgtgcattttagtaaaacgaaaagaattcatagccgcctccacatttttttctttcttctagtataaaagctgaaagggatggatacaatatggctatcccccgtttttcatacataaaagctccctgcattcatttgcagggagcttttatcatgttatccgataaacattccggcgatcgccgcgcttaaaaggttggccaatgttccggccgcaacggctttcaagccgagacgggcgatatcggaacggcggttcggcgccattcctccaagtcctccaagcaaaatcgccacagaagacaagtttgcgaaaccgcacagcgcaaagctgataatcgaagctgttttgacggaaagctgatcaaacatcggagcaaaattggaataagcgacaaattcgttcagaacgagcttttgaccgataaagcttccggcctggaccgcttcatcccatggcacgccgatgacaaaggcgagcggggcaaatacatagccgagaatatattcgagtgaaaggtctttaaagccgaaccatccgccgactcctccaagaattccgtttaaaacggcaatcaaagcaacaaaagcaagcagcatcgcgccgacattcaacgcaagagagagacccgttgatgccccttttgccgcggcatcgatgacatttgctgcgtcttcgtcttcagccatttgaatatctttttcttcaattttcggtttttccgtttcgggaatgagcatttttgccataatcaagcccgcaggtgcggccataaagctcgctgcaagcaaatattcgagaggaaccccgagaagggcgtaaccgaacaaaacagaaccggccactgaagcgagtccgcctgtcataacggcaaacagctctgactttgttaagtttgcgataaacggcttaattacaagcggcgcctcagtttgcccgacaaagatattggcagctgcagaaagagattccgttttgcttgttccgagcagttttgccaatccgccgccgatgaagcggatgatcacttgcatgattcttaaatggtaaagaactgcaatcagagatgaaaagaagatgataacaggaagaacgcttaaagcaaaggcagcactgtcgcctacttgtaagagaggcccgaagagaaagctgatgccttcattcgcataattgacgagatgctgaacggcttttgtaaaccaaagaaacgcttccctccccgtttcccatttgagaacgatgaatccgaacaggagctggatcgccaaaccgattaaaatcgttcttatgttaattttgctcttatgctcggaaagcaggaaagcaatcgcgaaaatcgccagaataccaagaagtccccataaaatgttcatgaccacacctcttattattatttaaacttttattaagatatcaattaatgattggcctgtccacaaaaattttcacgaattttttctctttttatgtaaaccctttcatttaaaggctttgcatgaaaaaacgagatcaccaagatgaccccgtttttaaatgagttcattttcatcaatgaacttgtatatattttcgaccaattcagccggattattcgctgtcaccatttctccgtttacaagagcatacatcgtctgcatgcattgtccgcagtaactcaggcagccgtattcaacgacatccaaattcggatctttctccaatatttcctttgcctcctgagaaccttgggcaagattgctgacgcaaaactcaacgattggaaacactttatttcacctcacatcgcctttttttatcgtaccctaaatgcgtttcattagtcaaagtttaaggctggagaataaagcttttgtaacatattaatactttaaagagttttactaattatcgattctaggcgttagtgtaggttattttcccgagaaatattgtgattttacatcaaattagatataattctagagggtatttacatagttttttatttttgcagtgtaaaaggtgagtttcttaatctgaggggaaaaggggaattaccaatgagaaatttagtcttgctcggcggcggatacgggaatatgcgcatcattcatcgtttgctgcctaatcagctgccagatgatgtgatgatcactttaatcgacagaaacccttaccattgtttaaaaacggagtactacgcactggctgcggggacgatttccgatcatcatatcagagtgtccttcccggatcacccgaagttaaagattgaatacgggacgatttcgtctgttgatttggaaggaaaaaaggttttgtttcatgacagggagccggtatcctatgatgacgccgtcatcggactcggctgtgaagataaatatcacaacgttcccggggcgcctgaacatacctacagcattcagacaatcgatcaatcacgcagcacgtaccaggcgctcaacaacttaaatgcggaagccaccgttgcgatcgtcggggcaggactgagcggcgttgagcttgcgagcgagctgagggaaagccgaaaagatttgaacatcatcctttttgaccggggagaattaattttgtcgagcttcccgaagcgtttgagcaaatatgtgcaaagctggtttgaagagcacggcgtcaagattatcaactgcgccaatattacaaaggtggaagaaggcatcgtctacaatcatgacgacccgatccaagccgacgccatcgtctggacagcggggatacagccgaatcaaatcgttcgggatctcgatgtggaaaaagatccgcaagggcgcgtcgtcctgacgccgcaccataacctgccgggagacgaacacgtttatgttgtcggcgactgtgcaagcctgcctcacgcgccgagcgcacagctggccgaagcccaggcggaacaaatcgtccaagtgcttgaactgcgctggaaaggcgaacctcttcctgaaacaatgccgaaattcaagctgaaaggcgtcctcgggtcgctcggcaaaaaagccggtttcggtttagttgctgaacggccgttgatcggcagagtgcctcgcctgctgaaatccggcttgctttggatgtataagcatcataatgggtaggtttgccgcgtacatgcgcgaaaccttggagttttagataaacagcgtttttctttcggggcgctctctcgccttcatgagaggatgccccttatttttgcgcttttttatttccgccaaaaagtcgagcagtccgccttatccgcaatattaaactcgatcattttctcaagcaatgaaaaatccaccggacgatcccagcggaaacggacaagctgcttcgtatgatcatagccggcctgcacaatttcctcagaaaaacgatcgatcccagcgctttcaggggcgacagccaaatgatttttcgcgacgctaaagccgataataaatgtgccgtgatcagtaaacatcggctgattccaagcgattttcggcgttaaatttggaaatgtctccgctacccaacccaatacttcttccatccgggcacgatgttccggatgatcaattcccgctaaatattcttcaaagacttccatgctgctccctcctaaaaatgattacatgctaaattgcgctgttcagtatagaatttcccctgcaatctgtctattggcatgcctcacattggcgttaagaccattataaggatttatagaatgacaagcactataaatcgggcagatttttcaataggattcgaccaaaagccggtgagcgccattcctgtcatgtgtttcatatttttaatcttcgcaagcgatttgcagggacgccggttatatttgctttcataaaaaaagcgccgctggcggcgcttttcgaagagagcttgtccggtgacaagcagggttatgcggtgttttgtcaggcggctggcgaatttccgtcaaggctgtcgagaaagatcgctctgcccgccatcagctgagccggcttatcgtcaagaaaaatggctcggccggcaaactcggcatctcccttcggctgagacgaaaaacttaaaacgacaaggcttgcaaagacggcagtcaacgcaacggcaatcatctttttcactttaactcctccgttcttttaagaatttggtctcttgcatgatgagattcttcaaaatattcggcagctttgtctgcatctccattttctttatagtaaagtgcgatatcaaatgttaattccgctacatccgtccagagattgatcgttttaagatattctaaagcatgttcaaccgcaagtggatcctgttcatcatacagagcatgaataagtttaaatttcgacaaatattccctttctcctgctttttccgcacggaaaaatcctttttcatacaatttgcgtgcttctttgacaacatttgatttgtacagcacatgtgtcagttcaaacatggaatggatgccgtaaaccgattcttcatgctctttgataagcagcgcttctttgaaatgatgttcagccaatgtgaggaggttgcgattgacatagctcaaccctaagttgtggtgagccatgccgaggaggacatgatgtttgatcagtgccgcgtctttaagggcttgcttgtaatgctgttcggcttcatcaaaacgaaataaatcgagtttatttgccccgatcagcatatcgttgctgatcgctttttgaatgtaatcatcatgtgctttgaaggtttttagagctgttttcgcatggtttaaggaaaggaaattttgtttgatttgatagtaggcgatagccagtttgtaatggaattcggcgatttcgatttgatcggggattgtcctgagcttttcctcggctaatttataataattgattgcatttgtataatccttcttatgaaattcgtacatgccagcgaaaaagaaataataatattcaatcatgtcatctgtgctttgcatatcggctttttgctcctgaatatcctcgaacagtttgttggaagcggcaaactcttctgtcagcagcttgtgccgatagtctaaaagattaaaataaagaagcagatcttgattttcttccatattcggcagctggtgctcaatgtcgcatttaatcgagaccgcttgtgatacttcgtgacgcttgatcatgacataccattgattaagcattcccgcaacttcctcatacgcaatttttgtcttcaatcgtttatccttcctttcttcccatgtcatttcctttttatgggttgtttttcattttacagaatcgcttattttttgacaatcacttttctaaatattggcataatttcctaagataactcaaaattctgacattaatcgtaacaatcttctttatttgtgcaaatctctcaggaagtattttcgtttgacatcgtttttgacggcattttataattatatatgtaaatatcaacatgtttcgatttacaataaacaaataaaggagcggttcatatgaatcaagatgtaaaagagtttgtaggaagccatatgatctatacgtatgaaaacggatgggaatatgaaatctacattaaaaatgaccataccatcgattaccgcattcacagcggaatggttgggggacgctgggttcgcgatcaaaaagccgatatcgtcaagctgactgaaggcgtctataaagtatcctggacagaaccgacagggactgacgtttccttgaacttcatgccgaatgaaaagcggatgcacggcatcatcttcttccctaaatgggttcatgaacgccctgatattacagtctgctatcaaaatgaccatatcgacttaatggaggaatcgcgcgaaaaatatgagacgtatccaaaatatgtcgtaccggaattcgccgatatcacatttattgaaaatgccggaatcgataatgaagatctgatttcaaaagccccttatcccggaatgacggatgacatcagggcaggaaagcgggtataaaagggaaagttaatgatataatgactggacttttgttaagtcatccagcagcgcttttatatcatcttgcgacaaaggtacaagcatttggtcgtagagggtgatgatctgtccgtcctcatcgtgctcatgctgccttaaatagtgctgtaaagccttgagctggttttctttcagactggtctgcgtttgaaactgcttgattttctttaatgaaaaaacattcatttcgtcatcaaaatcgcctgacatgatttgtccttcaatgcttgacatgcttgctgtccctcctaattgatctggctgatagttagtctgtccggtttaagaaaggtgcaatcataaaaaataaaacagcaaggggcatgtctgtcccttgctgtttatcatgcaggcttatatccttgcttttccatttctttatacacgtctttcagcttcggatttccttcgccgaccacttgatcaccgaccatgacgagcggataaaaatattcgtcgttcaggattttttcggagatttcctgtttttcagggtcgttttccggcggctgatggatatcaatgtacgtgattgagaaaggctggtcgggatattttcttttcagggcggcttctagccactcatacgtttcttttgatgacggaaggttcacacagcttggacaaagaacgtcggcaccgtaaacaaaaagctcggcttgttttttcatcagcggcagctcctttctctttatctttattttattctattttgtccatctgctccatattgaaatgaaaatcgttttttgtctttgccggcaaatatgatataatatgtgggaaaacgattgaaaccaaacaatagctttttattgttcgactgaatataatggttgtatgatttgaaaggagcgatacgaatgacgacagaggtcgaaatgaaagaacaagtacaggaagtgctggacaaacttcgtccgtttttactccgtgacggcggtgactgtgaactcgtcgatgttgaagacggcatcgtcaagcttcgcctgctcggcgcatgcggaagctgcccaagttccaccatcacccttaaagctggaattgagcgcgcccttttagaagaagttccgggcgtcattgaagtagagcaagtattttaatttgagaaggctgccgtaacggcagcctaaattgttgacaaaatcctaaaacggttttcagtttaggattttgtcatcctctcagcgtgattgaaaacccttgcagtctaggaaggtcgagcatcggagcggagcgaatgttggaattcgtgagcaccgacgcgcagccctgacaacgaatgcgagggtttgtcgacacgctgaggctgccgtagtgtacggcagccttttcttttttatagataagcttcaaaccagcctgcaatatactcaagccgcctgatccgctgcttcggatgcccgcttcttgataaatcgtgtgacgcgttcggaaatctgacgagttttacttctttccccatttttttcagcgccgtaaacagctgttccgcctgttcaatcgggcacctgtcgtcccgttcgccatgcagaatgagaagaggggtctccaccttgtccgcgtatttgagcggcgaatgctcccacagtttgcctggatcttcaaaaaggtctgcaccgagctgccagtctgtgaaaaaatagccgatgtcgcttaccccgtaaaaactgatccagttgaaaatggacctctgtgtcactgcggccttgaagcgcttcgtgtggccgacagcccagtttgtcataaagcccccgtagcttcctccggtgatgccgagcctttcttgatcgacgaaatcataatgttcaagcacgtggtcaacagccgccattacatccttaaaatctccaccgccgtagtcgcccctcacccggttgacaaaatcctgtccgtagccgtggcttccccgcgggttaacatatacgacggcgcttccctttgcggccagcacttgaaattcatgaaaataagcattcgcatacatggcgtgaggtccgccgtgcacttccagaatgagcggatacgtgtttcctttttcatattgggcgggctttatcagccatccgtgaattgtcagaccgtccgctgcctgaaattgaagctcctccggttccgatatgatatgttcttccgtaaacgcttggttggcatctgttagtcgctccgctttttcttcacccaattggagatggtaaagttcgctcggccggacgggcagggctatggatgccgcaaagccactttcgtccggatgcaggctgaatccgttcacatgctctttttccaaccggaccggataagcaagaccttcgattgatatgtagtaaatgcctgtagaaccctggtcagatccgatgacataaaagccgtttccgtctttggtccaggccggtttcggaagaacgcctccgacaaggctgtctcctgccaccgcatcgctgagatggacgtcaagcatttccgtcagacacgttagttttcctgtttcaatatcatacagccatgctttatcgagcgtggcgttttgatattctttctcgtttccgataaatgcaaggtgtttgccgtcaggagaaaacgatagtgaagaaaaaatgccgttttgacctgtgaggcgcttcaaatcacctgtcgaaaggttcatcaagtagacatcgttcacacgcatatccgtttgattggcgcaaaatgcaatctgatctccgcacggtgaaaatgcatggctgaaatggtcgcgttcaagatcggtcagctgtttcatttccccggtttccacttgaacgaggacaagctgcgtatactttccccttttaaacccttggccgtctgctttatatgacaaagaatcgacttccagcggttcgtggtcttcaatctcggttttcttctcatcgtcgacgctttcctcttttgtcagcttcactgaacaaagcaatgacttgccgtccggcgaccattcaggctgtgatacatcatagggaatatcggtcacttttctcgcttctcccccggcggcgcttatcacgtaaatttgtgcggtttcctcgcgattggacgtaaatgcaaggtatttgccgtccggcgaccagcggggatgctggtttctgcctttcccaaacgtccattgcaccgaagcttgtttttcgcggtcgtagatcatgatatgcgaatcatatgagtcctgtttttcgtttacttttgtttggacgtaggcgatttttgcaccatcgggcgaatactggggatcggtaatggatacaagcttgatgaggtctttttcggttatcagctgcttcatgtcgtttctcctcctcatgtctgtttgccatactactccgacttcctaaataaaaatccttgttttgaaggcaaacaaaaaaagagccgaaaaagctcttttttcgttaaacactgtttactgattttctttcaacgataatgcctgtatccgggacataaaggcagtcgacctcacagtgcggaaacttggacgcaagctggtttctcagcgcctctccttttcctttttcaataaaggaaaggatcgtcgggccggctccgcttaaagccgtcccgaacgcgccgttttggcctgcttcatgctccactttcgaaagctcagagacgagcgcccttcggtatggctggtgaaagaggtctttttgcatcatgcggccgacaagcttccaatctttcgccatcagtccggcgacgagcatattgctgaccgcgcttgcttccacggctttcggataagagaggctttcgggaagaacatcccgcgcatcttttgtcagcacttcataaaaaggaatgacgacgacgacatccaaatcgatgtctttcatagaaaccatctctgtttcatcttcctcatgaagtccgatgacaagcccgccgaaaagcgatgctccggcattgtcaggatggccttcttcaaggctcgcaaaatgaagtttctcgcggtctgaaagcttcaaatcggcaagttcgttcgccagctcaaccgcagcggcaattgcggctgcgctgctgccgagaccgcgcgcaagcggaatatcgctccacactttgacaaggcttggcggaaggtcttttccgaagtgtgcggcggtccgtttggccacctggtaaattaaattgtccgttccttcaggtattcccgctacgacttctgtttcagcttcaaaacgccactcatcatgaggaaaaacagacagtcttaaatagcgggacagcgccatgccgactgaatcaaagcccgggccaagattggccgtgcttccgggaaccgtaacggaaaacagcatgtcagcctcagtcatacacgagcggctccttttaagtgttcgagaatagcttcttcgtctgtcggcagtgtgacaggtttgatctgcgacacatcaacggctgtgttcggatctttcaggccgtttccggttaagacggcaaccactttcgcacccggctgaatctctttcgtttgcagctgtttcagcacgcccgcaatggatgcgcatgatcccggttctgcaaatacgccttcttctcttgccaggagctgataagcgtggagaatctcctcgtctgacactgcatcgattttaccgttcgattcttttgcagcgttgaccgctttatcccagctagccggatttccgattctgatcgctgtcgcaacggtttccggcttttcaattactttgtttttgacaatcggggccgcgccttccgcctgaaaacccttcatgaccggcaggcctgtgccgtttttctcatgatactctttaaagcctttccagtaagccgttatattaccggcatttccgacaggaatcgctaggatatcaggcgcttcgcccagctgttcacaaatttcaaaggaagcggttttctgtccttcaatccggtatggattcacagagttgaccagcgcaatcggctctttctcgcaaatgctgcgcaccattttcagggcatcgtcgaagtttccgtcgatcgcaatgatttctgcgccgtacatgacggcttgggccaattttccgaaggcgattttgccgtctggaataatgacgatgcacttcatgttggcgcgggccgcataagccgccgcagcagccgacgtattgccggtcgaagcgcacatgatcgtgtcattgccttcttctttcgccttggcgaccgccatgaccatcccgcggtctttaaaggagcctgtagggttgacaccctccgtcttgacataaagctcgattccgagctttttcgaaaggttttgcagataaataagcggggtatttccctcgttcagcgtcaattccggtgttttgtccgttactggcaaatattctttatattgatggatgagtcctttccacattagctccaaccgttcccttctactcgataagtgcttttcacctgatgaacaacctcaagatcgttcagcttttgcaggatatccgtaaaatcctcttctgacgtatgatgtgtcacaatgacaatctcagccaggtcgtcatggcctttaatcggaagctgaaggatcttttcaaagctgacgcctctttctgaaaaaatcgatgtgattttcgaaaacgaaccaacctggtctttgacatgaattcttaaaaactgctgggcaaagatttcagacggcgcctttatcttcttttcaaactgcggatcgacaaagctgctgccgttcacgccaagacgcatgtttttcatgacggagaccaaatctgacacgacggcggttgcagtcggcatgcttccggcgccaggtccgtaaaacatcgtttcccctacggcttcgccgtatacgtaaaccgcattgaattcattatggacggaagacagcggatgatgctccggcagcaatgtcggctggacgctcacttcgactttttgtccgtcgcgctgagcgatgccgatcagcttcatcgtatagccgagccgtttgctgaaattgatgtcttcatcagacacttgggaaatgcctttcactttgacatcgtcaaggtcgacattcattgagaaaccgagcctggccaaaatcgccatctttctcgcggcatcaagaccttcaacatcagctgtcgggtctgcttctgcgaagccgagctcctgcgcttctttcagcacctcgtcataaggcgcgttttctttgttcatcttcgttaaaataaagttggtcgttccattgacgatgcccatcatcttcgtaatccggtctgaagccagcccgtcttcaaggcttcgcaaaatcggaattccgccggcgacgctcgcttcaaaataaaggtcgcagccgttttctttcgcggcagccgtcagttccgatccatagagggcgatcaaatctttattcgctgtcacgacgtgtttcttcgcctgaagcgcgtcaagcaaatagcgtctcgtctcctcgatccccccgatgacctcgataatgacatctacttctggatcttgaatgacatcataggcttcagtcgtcagaacgtctttggaaagctcgacatccctcttcttatctttatcttttacaagaactttttgaatcgtaacagggcatccgacttggtgtgtcagcttatcctggtgatcctgaataatcttcaccacaccgctcccgactgttcctaatcctagcagccccactcgtatcgccttcaatgaaattccacctttctctctcttgtccgtcctctctgaaaggacatttgtaaacacaacgcagacatttaagttacaaacattataatgggggattctttttttgacaagatgacatttgctgaaaacaaaacgtgaaaacgctttagtcgttgatataataagattctatatattcagaaatatttttgtaagaaaatcttccgagccgctcagggcagccggaagaaacgtcaaatctcggtctttgcctgctttcctctcaggacaagcgcaatattttccgcacaaagcctcatcatggcttctctcgtttcgacggcggcgctgccgatgtgaggcagcgcggtgacttgcggcaggctgacgagcgggtgatccttttgcacaggttcttccgcaaagacgtcgagtcctgcgccggcaatatctttttcgaccagcgcttcatataaatcgtcttcattgacaacctgtcctcttgagacattgataaaaatagcggagcgcttcatctttttaaaagcgctgcggttaaacagatgcttcgtttcatgagtcagaggtgtcaggcagacaacaaaatccgcctgttcaagcagttcatcgaagggcagataggatgcgcccagttctgcttctgcatctggattgcgggtgcggttatgatataaaattttcatgccgaagcctttcgcacgccgggcgacggcttgtccgatgctccccatcccgacaatgccgatcgttttatgatggacatccgcaccggccaaaagcagaggaccccagcccgtccacttcccttgtctaatccagtcgctcgcttcgacgattctgcgggcggatgccatcagcagagcaaacgtcaaatctgccgttgactctgtcagcacgccaggcgtgttgcagcagatgacgcgatgcttttgcgcagcctccacatcgatgttgtcatagcctaccgccaagttggccacgacttttaaatgcggcgcgccttttaaaagctcctcatcaatcgtgtcggaaagcatcgtcaacagtccgtgcgccttttttgctttttctttcagaatggcgcgcggacacggttcttcttccttttcccacatttcaatatgggcttcttcttttaacgcagaaagctgttcttcaggtaattttctcgtcacatatacaaacggtttgtccatgctgcctcgttcctttctaagagtagcttccactctaagcatatcgaaaaaatccgaaaatgttaacagaagaaaagaacaccgcgaagctatggtgtccttttcagccaattgacaggcggcatgcttatcaatcctgcggatctcatgcccgccatttcttgaaagccgttcaggaattgctcatatgccggcgcctgagacaataaatagtcgagtctgctttcaaaataatggtgctctgattcaggagaaatatagtacccttcaaccgtctcaaaatagtggagcggaaacagcagcctgctgtacatcagccgcttagaaaatgaggatagcggcgcggcttgttcgtattgctgaagaaacaacatgatttcattgaagtttttcctttcgtgaaacaagcttctggcatattccgcaagatccctggccgcatgatcaaacacccattccatcgggattttaataagcggctcgcgccttaaagcctcgcaggtgagccgctgctggcaaatcgttcccgagtcagcggcctgcggctgatcatccaattcggtatctgccaaatattgaatcgcattttcggttaaaccgagataataaggaaacgattcgataaattgtttttcaaagggctgcagctgccttgcctgcgttttttgaatccagaattgttccagctggtcgagccgtttcccccaaagttctttccactgcccgatccgcgaggtttcttttacctcgtaagggtatccccttcccttgtgatgaaattcggcgagctccgcaccaaatgaaacggacctgtttgtcatgcggggagcagcttgaagaagcacatatgagacgccattctcctcaaacgtcatctccccgtcctttgtcaatataaaagatgaaacgtatgggtcgcgctgttcttgcaaatactgactcatactaaacaattccgccagctcatcctgactcaagtgggaaacagggacgatcaaaaacatcgaattcggggtatgaaaagcctgataagacaagtacgatgtaagatcgcgaatgtagattccgaatttttctttgatcagctccttcacggacatcacttcctgcaaaatttttctccttctacacatcgtaatcatgaagggattcgattatgaatcgatctggaaaaagagttctaaaatcgttacatttttaaagttgtttgtatacactaagtaaaaaaagattgggtgaaaatgatgccggaaaacaacagcatgcatcagatcgaaacagcagcaaaagaatggcttgagaaacggggcgtcaagatttcggaaattgccgatcttgtctacgtattgcagaagaaatatcatccaaacttaacaaaagaagaatgtgaagagaatgtcaaccgggtcatgaaaaaacgtgaagttcaaaacgccgtgatcacagggattcaattggatatgctgggcgagcaaagaaagctcatggaaccgctccaaaccttaatcgagacagatgaaagcctgtacggcgtcgatgaaatcttatccttctccattgtgaacttgtatggatcgattggttatacaaattatggatatattgataaaatcaaaccgggagtgctcgcacgtttaaacgataaatcaacaggcgaatgccacacgttcttggatgatatcgtcggagcgattgcggcagccgcatccagcagactggcgcatcgagcaaaagatgcggaataagccattaaaaaaacacttgtctttaaaagacaagtgttttttgcgttagacgcgatccagccattctgtcagtgaatcaatgacatatgtcggcttttcctgataggcttcaaggtgttcttttttggtcacgcccgtatgaacgagaagcgtgtccatcccggaattcattcccgccataatatccgtatcataattgtcaccgaccatcagcgtttcactgatgtctgtgccgagcaccttcatcgcctgctccatgatgatcggctccggcttgccgataaaaataggctctgtctgcgtagaaacagttaatactgacgtgagagaaccattgcctggcaagagtcctctttctgtaggaatggcgatatcgccgttagtcgagatgaatgtagcgccgttgcggatggcaagacaaccgacggctagcttttcgtatgtaatgccgcggtcgatgccgacgacgacaaagtcggcgtcttccccgccgaatgccagccctttttcctcaatggcctgacggatcccttcttcgccgatcacatatacggaagcatcgggtttttgttcggcgatgaaattggcggttgccatgctggttgtgaatacctggctctcttcggccggaatatcaaatgaaacaagcttgtccgccacttgcttcggcgtgcgcgacgagttgttcgtgacgaacagatacgggatgttccggtctttcagcttcctcacgaattcgcatgcttcttcgattttttccgtccctttgtacattgttccatcaagatcaattaagtatcctttgtatgttttcatgttgtacactccagttcgtttagtgcggtttgaatgcggataccggaccgagttcatggtttaaataatcgcggatccgcgccggaaatttctcgagcgtttccgcatgcctgctgagcagctcttccaattcttcatggttgacgttcaggtagtcttggaccaatgtcttccgataggcgatcaaatgtttcaaactgtcgccttccgcttggctgacaaccttttcatcggtcagtatatccataatgtcgtcatagcttcccggatctctcataataaagccgtcaatcatatcgttccctatatccaatatacattcgatcagcgtgtggccgattcgttcaagcgcttttttttcgacgtcggaagtccattcttcctgcatttgataaagccgcagctcctcttccaggaagttgagcgtgttttcgattttgtgtcgatcgacaaaatacatcatcagtgcatccccttttatgatcgcttattttcgcagacgttttaaaacaaagtaggcacatccgaaattgcagtactcgtaaatatattcatcaagcgtgctgatcttcgtatcaaatgtggccttttgattttgatcgtcaaaaaagcctttcagcctcagctggctgtatccccaatccccgacgatgtagtcgtatttatttaaaatgtcggagtatctggctttaaacgcttcttcgttaaaaccgtttttcacatctttgacgacttcaaatgcagcgttctgaacgacaatcattcttttcacctcttttatatgataattcaaacccgggccgccatcaattgctaagaataaatcctcccctttggaaaagctataaatgaggaggaaaagcagatgaataaaaaaattcttttagcagggctggtggcgctgcctttagcaggctgccagacggccttaaacgataccgaacacaatatatatgacgaagacggaaataccgttcacgttgcagacaagaaccctcaatatcaggaaaagttcagaaatgacaaccgaaaaggcagattcggatatgcgcgccatcaggcaacaccagtcgcaaacaaggaagaaatgcaggcgccccaaatcgaccgggaagaaatggcgcatattatatctagtttaacggttcagcttcccaatattcaagatgcgtcggcgcttgtgacagacgaagaggcgctagtcgtgtacaaaacggactccgggcagcgcaaacagacggctgatcaagtcaaaaagacggcggcatccgtcgttccgagatattaccatatctatatttccgatgatccggacatgatgcaatccgtcgctaatttcagccggcttggagccaattcaagaaacgtcgatcagctgatggccgatacaattaaggaaatgcaaaaatcgccgcaaggcaaaaccacgacaggtacagatgaaaacggaaacgaccttgacggaaaaggaaaggcgaccgaatcttgacctaaaaataagaaaaacgccagcgcatatggctggcgttttttcatccaatgttatgcctgcgcctggcgttttttagacgcttcattcacctgttcgtcggcatggtatgaagaacggacgagcggtcctgcttcacagtggctgaagcccttttccatggcgatttctttcagttcggcaaactcgtcaggatggtaatatttctgtactttaatgtgttttttggacggctgcagatactggccgattgccatgatgtcgacgttgttcgcaagaaggtcgtccattgtttcgatgatttcttcttttgtttcgccaagaccgatcatgatgctggatttcgtcgggatgtccggctgcatctctttggcgcggcgcaaaaattccaatgatctttcatatgtagctctcgcacggactctcggcgtcaggcggcggaccgtttcaatattatggtttaaaatgtccggacgcgtatccatcagcgttttcaaattattatagtctccgcccatatcggacggcagaacttcgattgttgtaaatgggctttttctccggacggcgcgtacggtttcggcgaatacccccgctcctccgtcttttaaatcgtcacgggcaacggctgtaatgaccgcgtgtttcaggttcatgatgctcacagaatctgcgactctttccggctcattcaagtcaagctctgtcggcagccccgtcttcaccgcacagaagcggcaggctctcgtacagacagatccgagaatcataaaggtcgcggtacgtctgacggcccagcattcgtggatgttcgggcattttgcctcttcgcagaccgtatggaggttgttttcccgcattaatttttttaagcccgtatagttttcattcgtgttcagcttgattttaagccattcgggctttcttaggtgctcgtctttctttgccaattccatcatctccattgtggatagtagtcatgttcaatacgaaatttgtgacatagcgccggatgagtccctctgctttggaaccgcttaaataaaaaatgctaaatcttcatctttagtcactttaacatagtacagatttgtgaacaagagcttgattagacaagatggaatttctaacattttcttattattgatttctgcagatgtcacaaactaaccgtattcaaactgaaaggagctaaggacactgtgaaagctgtattatccgttctcatcctccttttgctcatcttgcagccgtgcgctcttgcaaaggagaaaaaagagcccgatctgcaaaagagaatggccctttatcataagacagaagccgcaacccatattccttggtatgttttcgcggcagtcgaccaatacgaaatcaatatccgcaaaaaccgcaaagacttgccgaagcaaaaagggcacaccgggatatatattccgcaaagcgtgtggagcggacctgaaaaccccaatcctaaagatacatcgccgctcagcatcaaggtttttgacggaattggaatggacggaaacggagacggactcgcagaaccggatcaggatgaagacgtcctttatacgtttggacaatacttgttgacatacggaagggacattgaaaatatccgcatcggtctgtgggagttttacgaaagggatcagacggtcggcatcatatcaggctttatcaggctttttcaaaaatacggccacattgatttgggcaagcacgcctttccccttcccgtaagatcagattacagctatagaagcacatggggagatgcccgcggattcgggggcagacgcattcacgaagggacggatttgttcgcccattacggcctccccgtccggtcgacatgctacggcattgtggaaatgaaaggctggaaccgtttcggcggatggcggatcggaatcagagacatcaacaatacgtaccattatttcgctcatttgaacggtttcacaaaaggcttgaaagtgggagaaatcgtcgagcccggccaggtgatcggctcagttggagcgacgggatacgggccgccgggaacatcgggaaaattcccgccccaccttcactacggcatgtataaagacaatggaagaacagagtggtcttttgacccttatcctcatttaaaggcatgggaacggaaggaacttcgaaagaaaaaataaaagacatccctatttcaaaagaatagggatgtcttgcactttaagaggttagccggcctggcttttcttgcttttcacaaccgcattgataatgcttgcggccaatcctccccaaataatgacgatgccgatcaccatcattgctatagatgcgccgttcatgaggaaacctccttgtcatgttgaaatggcgtatatgccagcccattcttccattttgaaagcgaaaggataaatccggctgcgatcgctccaaaagcgacgcaccatccccatttcaggaggaattcaaccggcaggtcgccataggctgttgtgatattcgtcttgatattatcaaacatcatataccccagaacaatcggggtgacgacgctcaggcagattctccaccaagcgccgagctgaatgtcggaaaccgaattggcgtgagcctgcagagctttcagctctttcgcaaaccatgcaatcgcaacgacttcgatcaatccggcaagcgccactccgaaattgttgataaagtaatcggccgcatcgaggaagaacagtccgcctttcgtcgcaaatacgagcgaacacaatgcagcagcccctccgccgaacaggacggctttccgccgcggaacgttgaatttatcctgaatcgcggcaacatatgtttcagagatagaaatgagagatgtcagacctgccaaaacgagcgagccaaagaataaaaatccgaaaaacgcattaaacgccggaaactcattgatgatttgcgggaagacgacgaacgccaaaccgattcccgaagagacgacttctttgactggaacgccttgctgcgcagccataaagcccagcgcactgaataccccgattccggccagcagttcaaatgacgagttcccaaagccggtgataaacgcattgtttgtaatatcggattttttcggcaaatagctggaatacgtaatcatgatggcaaacgcaatcgacagactgaagaaaatttggccgtaggccgccacccacacttttccgtttgtaatctggctccaatcaggcgtgaaaaaggcattcagtccttgtgcagccccatcaagtgttatcgaataaatgacaatgataaaaaataagaccacaagcagcggaatgaaaatgcggttcgcgatttcgattccttttttgactccggcaaataaaatccccaatgaaacaatccatacaatcgcgagcggaatcaggacgcccggcacgaagccgccgaattggccgatggctcctcccccgatatcaattctgtttaaatatttattcattaggaaattttctgtatttttaccccaacctaaattgaatgaaaagacagtgtaagaaatggcccatgccacgataacggcataatacgtcgagatgacaaatgagatggcgacctgccaccagccgatccattccttccctttccccatcctggcataggacagcggggctgagcctctgtatttatgaccgattgtaaattccatgatgagaagaggaattcctgctgtcaagagcgcgaacaaatatggcagaaagaacgcgcctcccccgttttcataagctactgccgggaatctccaaatattccccaaaccgatcgcagaaccgacggctgctaaaataaaacccgctcttgttccccattgcggacgattatccataagcttcctcctttacctttttgaaacatctgaaaacagtgaattttctaacaattattattgaatagtatatacagtctttttgcctaagtcaaagtatttttttaagaaaatagacgcatgtcatttctaggccgcgcgaaaaaaagcattctgcctgatgtttgcagaatgcctggaaatcattactctttttgttcctttttttgctctgttttttcatcctttgaagggatctgaatcgatggcgccgtttggctgccgttgccgctgtagaagtcgggtacttctccgtgcacagcttgaatcgttgccggaatcgtatttttgacaaccgccgtttttgtcgcaaacggtatgacgacacggaccttgacttcgacaagcacaccgacatttattaatgcattattaataccatatggctcgacactttgcttaaaatctgtaaagacatcccccacaacattaagccgtacaggtattttcggccccaggtttccaagaagcgagtttcccgttgcctgacccagaggaatattatagattacaccatcattcttaccttcgggagttttcgcagaagaattaaattcttctgtttctgtttccttcagcttttcgtgaagttgtttcgtaattttcgaatgcataccacgaagaccatgagagttgaaatcaattgttgttacttttccattttcattcgtcttcatttctactagatttttcacattttcatcttggctcatataatcctcgacggcttcctggatgacgtgggtcgcaatccggttcgtttccatttcagcgatgttcagaagcgtcggtttgatggatgagttgataatcaacaggctgacggccgttgaaaaaataaaaaatacaaacgaaagcagcatgacatatcgcaaaggcaaaggtcctctttttgacagagggccgcgaagtcttcgcaagcaaaatccccccttacatcacaagtgtatgcttgtaagaggggatatacgattcaatcagacaactttatttcaccatttttaaaagggcttcttttccgctcattccgggatgaatgccgagctctccggccgcatcggttacagattcgagcggggcttcgagaagctgatcgatcgtccgcacgccgacggctctggcggcgacgattttccgttcttttaatttatcattcagcagggcgacatcaagcgctccgcacataatatatccatggtcattggttaccgccataaagttcgttttcggcagtttgaccgttacagccgtaaacggctgatcttctatcatgatcggagttaaatttaccatcgctatccctcctttaccattaatgtatgataaagcgagagacatgttccggtttgccccgaatcttagagatctgtttaggaccggtttgcttttttcagcttccaggcgagcagatcgcgcaggaattcaggcataaagtagtcaatatcttccgcatcgcggataacaggaaacagcgttccgagtgtaaacatatcaatcgtggcgagcgtgtagaacgcatcatcttcaatgtccgctccgttgacggagagcttttccgggtcaaggccggcatacagcatcttccccatcacttcgccgcgaaaaccgagccctttaatgcgcagcttctcggtttgttctgatgatgcatggaggatgacctctttcagctctcgtcccgtcagcttcagtttgaccggattaatcggatgcggacagatgcggtgaacatcggctttcgtcaccggaccttgtgaaagagactccagcacaatgcctgagttgaccatcccgatttccgcctcacaccattcctttaaggcatctgccagcatttgcggaagggcgcttctgcggaaccaggcggtttcaagggtgttgtccaatgtcgcaatttcctcttcaaggagatgtccggcttctctctcttttttcttcagaaaacgaatcgtctcctctgattcttcattccaatctgccgtcttcatcacggttgctgtgatgttctcaagcgctccgttatatgtcagttcaacatgaccgacatagttcccgtacttttccgcgcaggccagcataacgccgtctttcatcatcccttcttcaagcaggtgatgggtgtgggagccgaggatcaggtcgatttcgggaaaagcctccgcgacgcgctgatcgtccaaaatgccaaggtgtgaaagaaggatgacagtatcggctttttctttgatttcacttagcatctctccgatgctttcaaatgcgtctgtaaccgtccagccaagctggcgatagatcggatagtacgggactgtcacaccgagaatggcaagagttgcgccgctcttcacctttttgagcaaatacggcgctgcccagccgggcctcttcccttctccgtcaaacaaattggagacaacgacaggaaactgagcgttgtcataaagtgtatccaactcctgatgcggcagtgtaattccttcattgttcccgatcgttgcagcatcatactgcagacggttcaacagctccacattcgcttttccgaaggtagcctcagatatcggatggaatctgtcgacatgatcgccgaggtcgaacaaaagcacttcttccccctgctcttcatgtttctgtctttgtgtctgaatgtaatcgacgattttcggccagttttcaaaatggctgtgcaaatcgttcgtatggtagatatggagcttttccgtcatgcaaatctctccctaacgtttaactaaacacgccttgatagattaatctgattccgatgagaatcaatacgaaccgcatgatcaatacgatcgtctttgtctgcatctttttgttaatgtaggcgccgagctgtccgccaaaccaggcgcccgggatcaatgcaagcgcataaagccagttgacatgtcccgagatgacatggccggcagagcccgcgacagatgaaaggaaaatgataaacatcgatgtcgcaacggcgacccttgtcggaaataaaaacagaagaatcatcgccggcaccatcagcgagccgcctccgatgccgaaaagcccgccgagaaagcccacaaaaaaggcgatcgcgattccggctaaaggatggtatgaatacgtatattcctgtccttcatcacctgtgaacgttctgataacgcccgtatgctttttctcggcaggtttcacccttttctttatcattaaggaaagggaaatgaggatcataaaaatcccgaaccatagagaaaacgagtctgagctaaaatatgtcgatacatgggcaccgacgatgctgcccggccccgagccgatgaaaaaaataaggccgcttttatagtcaacggttttatacttcatatacgcaatcgttgaagaaagccctgtgaatatgatgacgaccagcgatgtgccgaccgccatctgcggtgtcacatggtcaaacagcgtcggcagccccgccagaaaaaggagcgagggaacgatgacgatccctccgccgagcccgacaagactgccgatggttcccgcgataaacccgagtatgatcaagataagatattccataaaataagtcctcttttctagctgaataaatcgagctgccttggcgtaagccctttgtattcaatgttgagcagctccatcatttgcttcccgttttgagccgcatcaccgcccgaattgttattaaacagcacgtaaacgtttttcgactgctgttcaagcagctcaaggtttcttttccagtcttttaattcttgttcattatataaatacaaatatctgacctcacgccaattttgaccggaagatggccttaaccagccttccttgttgcggccgtgaaaacggacgagcgttttccggctgtcagtcgcgtgaagaacagtcgggatgctgccttcgcccgcctggggttcatcgcaaatgctgtgaatccattgctgctcctccataaaagcgagtgttttgtcgtaaaactggggcataaaccatgaccgatgcctgaattcaagcgcacacgggatatctcccattttctcttttacccatcttaagtaattgacgttttctttcttgcaatcaaaccatggcggaaactgaaagaggaccatcgccagcttacccgcttttatgtatggcgttaatgagagcttaaaagcagcaaacatgtcgtctttcgtttcaaaggggatttccccgcgctgatgccctgtcattccctgatatgccttaacgataaactgaaaggtttccggcgtctcctttacccacttttcattgttccgctcgggctgtatcgcgtaaaagctcgcatcaagctcgacgatcggaaaatgcgatgaatagtggatcagcttgttttgactgcttgtcttgggcggatacaggctgtcatgatccccccatcctgttaatccaatataaatcaatgcagttcacctcttcttttagtttatcacaggtttttttcgaaaatcttgatccaggtctgcttgtagcatttcctttttcagcggcgggatacttgaacatgaaaaagaagccggacatccggcttcttttaacgggctttcctcggaaaaagggtaaagctgaaactgtacaaaaaatcgatgacaaggatgatcgaccataaagaagcgatgcggattaatggttccgttctttccgggtcgccgatgaacaggtgcatcccggccagcagagccgctccgatcagccatgcgatgaaatggcgaaaccagccttcacgctcttttttggcgtgttccctgccgtactgcgggcctttgtcaggcttcggacctccggcaaagcgataggcaaacctttcatccgcccatttgatcatgcggctcccgaacgcgatgctgacgccgatataaacggcggcgatgccgtgcaaaacatccgcttgcgccccattgtgcagatcaagcgacgttgcagccaaaagcagtaaatccaaaaccggtgtgcatgcaaacatgatcaaaccagcctttttccagcctgccatatagcgaaaaataagtccaagcagaataaaaatccaaaagccgatttcacaagctaaaatcaataaaccaatcaccttttatccgcctctctttttttaacacattcgtactaaaaaaatataacacagatgtattaaataatacacccgtgttataatgtggtgtatgccaaaaatagttgatcacgaaaaacaaaaagaaaaaattgccgaagcggtgtggaatgtgattcacagagatggacttgaacaatgcaccgtcagaaatgtcgctaaggaagccggactttcggccgggtcgatgcgccattattttccccatcagtctgagcttttcatttattcaatgaggcttgtggcaaaccgggtcaaaacgcgtatcgaaaacatgacatttaacggtacaccggctgaaaacgtcaaacagcttctttttcagcttatgcctcttgatgaagagcgaaaactggaaatggaggcatggtatgcatttacagccaaatcgctcagcgatccggagctcaaaccgttgagaaaggagatgaatgaaggcatttattcagcctgcaaatcggctgttgaaatactggtaaaaaccgaaaaaaagaccgggatcgatgttcttaaggaaaccgagcatctatacgcccttgtcgacgggctggcgcttcatttgatcatggcccctgaaaggctgacggctgaaaggatcgatactgtattggcgggttatttaagatcgttggaataggaacagatctatcgcattgcaccagaaggaactcacacaaccacagaaaagcaggcctctcagcctgcttttctggatttaatgctcttgttttaaattctcacggatttccttcttcatttcttcgacatttcttttaataatttcaatttcgtatttctcttttgcatctggaggtaagttctcatctaagtattctcggagtttttcttcgctgcgagtatcatctgggccgattgatataactggtctgtttttccaatcacagaactaactaaaccaaacttatcaaaggcgttcagaagtacttcttcagttgttttttgatttggatcagccgcttgtgaagctgtattaaacagtaacaagaaaagaactaagaacaagattccgaaccgttttttcttcattattctctccttaaaataatttttcctaagcacagcattgagtttctatttttatgtatttcagctttccgggacaccgtttattcatattttaggagccggtcctgaaagcgttaacgagagaggtgatctttattttctggggaagtaggctcatgaggtggatcagtgtaagtttatcttctctgaatggagatatttgactgttttgcaacttcttcttttgctagcgattggaggcgttgtcattatttccgcctcttctaccttgatacctcctttatttattcacaagtctaatatagcataaacctctgcaaaatttttcaaattacaaattgatttcacaaattattttgctggtcatcacaaaaaaaacagcctgatcgcaggctgtttttctgcactagtgaaccgctttttgtatctctttcgttcagccatgttccacctgttgccccgcgcgtgccggagccgtcaaacacgagccttcctctatctcagaagcctactcatgatagaaatccagtgccgcctgaagcgcatttcccggcgatactgaagcacctgtgcgaatgagaacagcttcgagagcagccaatgtaaaaagaacattttctttccggcagctgtatcccatcgttccgattctccatatctttccggccagcggcccgaaagagctggcgatttcgacgccgaagtcgtcaagcatcatcttcctgacaagatctgcgtcaacccgatcaggaactttcacacaagtgacggtcggcagctttttccggccttccgtaaacaattcgagtcccatcgctttgatgcccttgattagtgctgtttcatggagccggtgtcttgagaatcgctcgcggagcccttcctcaagaacgacccgcgctccttcgcgcaagccgtacagcatcgaagtcgcttctgtatgatgattaaggcgcctcgggctccaataatccatcagcatgccgaggtcaaaataattgctggaaatcggcaagcgtcccgtttcaagcacgatatcttctcttgtggcaatgccccgttctacctttttcctttcattgatgcgcttttcaacccggctgttaaatgtgatcggcgccatacctgaaggaacggataaacacttttgcgtaccgccgacgaccgcgtcaagacaccattcatccgtattgacatccgtgccgccgattgtagccaccgcatcgactacacaaagcacatcaagctcccggcaggcccggccgatttcttcgagcggctgaatgcatcccgtcgatgtctcgccgtgcacaaccgcaacaatctccggtttcgtccgtttgatttcggagatgacctctttcggttcaaaaacgtctccccacgggcattccattgtataaacatcagcctggtaccgttcgcaaatctcggcaagcagatagccgaaccgtccgaaaatgggaatgagcaccctgtcccccggtttgatgagactggcaaggacggcttcaagcccggcccgcgatgtcccgtctatcgggaatgcccatttatttgtcgttcggaaaatctgccgaagcagcgccatgacgtcgttcatcatgtctgtaaatgcaggatcgaactgtcccagtacaggtgaggaaagcgccctcagcactctcggatgaacctcgacaggaccgggagtcataattgtccgtttcggaatattcatttcgccaattgtcatgatctttttctcctttcattcatatgccagcctgtataatacatgagtcaagagctcaacgccggctgcaagatcagccggttttgtccattcttccggcgaatggctgatgcccttccggctcggaacgaacagcagtgacgtcgggcaatgcgggccgaaaacctgggcatcgtgccccgccccgctgaccatctcctgataggatacgtcaagatcctcggccgactgttttgagagttgaatcaaatcccggtccatcctcacaggcttcgcatccgtcgtctgttcaactgtgatctgaacgttccattcgccggccagctctgtgaaataagcaaaaatatcgtcgcaataccggtccaacaccgcatcatgatgatggcggagatcaagagaaaaaacagcttctcctgatatgacattcggcacattcggctttgcttcaatcctcccgaccgttgctgttaaaagcggataagcagctttagccttgttcgtcaaataggaaatgcacaatgccgagacggccaccgcatcttttctggcgttcatcggcgtcgtcccggcatggttgctttctcccttgaccataaccgtaaaccgtctttgtccgacgatgtccgtgacaatgccgatttgacggccgctctcctcaagaatgctcccctgttcaatatgaagctcgataaagcacttcacatcacgcctgaacgggcgcctgtaccgccgttttccgaaaccgcaatctttcatcgcctgctcaatcgatactccgtcccgatcgtgcacagccggcgtcttttgacagtcaaacaagcccgttaaattccccgatccccaaaaagtcaaagggaaacggcttccctcttcctcgcacagagacacgacttcgattgacgttttcggcctgccgtacgtgtccagaaggtgtttggcagacaaaaggctcgctaaaatcccgtacgctccgtcgaatttccctccgttgatgaccgtatcaatgtgtgaaccggtcaagatcgctttcgtacggttctctgtaccttctattctcccaaacagatttccggcatcatcgaagtacggctctattccccagtcctccatcttttccttcaacgactgctgggcgctgagccacggctttgaatagagaagccttgtcacccctccttctccgctttcaccgaatgatgccagccaattgatcatgtcttcgatattgcgggctgtactttctccggtcttatgaataccaatggtcatgtaaagaaacttcctttctattttcttgttatatttctttacaactctctatataaatacaattttactggtaacatgaaaaataaacatcggcataaatgtcacaaatccgctcattttttgttgaaaatgactaaaatgacaaaggaggcctgtacagatcaatgaatatctatgacatgatgaaactccctgtatttaaaggcgcaacgcttgccgctggaaaggcgggcgtaacccggaacattgaacacatcaatatgatggatgcgccagatattgccgattatctgcatcatggcgaactcctcgtcacgaccgcataccatttaaaagaccggccttttttattgaaggaattgattgaaaggatgatcaggcggggctgcgccggactcggtatcaaaacccgctttttgcaggaaatacccgacgaggtgatcaagcttgccgacgagcggacatttccgatcatcgagctaaatgaagatgtccgcctcggtgatattgtcaatcatacactgagccatattctagacaaacggacggcagaactcgaacaggccatcgccgctcaaaaaaagttcacaagccatattatgagcggaaaaagcattcaatcgctcttgcataacgtctctgctgttttaaagcttcccgttcttctattcaatcagcacctcaagccgattgcctcctcaaaagcagatgccgccgggacgctgtcggattatgaaggaatatttcaaaaaggaaacagaacggggctcacctgtttttcaacgattcccgacaaacaaacctattcggtatttccgatctatactcatgaaaaaaaatgcggcttcctcgttgtctgcgggatgatttccccttcagacaaaggcttgctgttaaccctcgaacaagccgccaatgtcatcgcctttgagctgctgaaggaaaatgcgctcaaacaatatttgcgaagagcgcggaacgagtttttcagaaattttttggacggcgccttttcctctgctgaagaaattaaaaaccgagcaaaagaatttcagctcaagtgggatcaaaaatatgtgtgcatcgccggcaaattggaccgccgcgaaaaatcgctcagcttcgcggaaaatcagcttgaatcagattccgtgttcgaacgcctggaagaagagctggttgacttcccgtttcctccgcaccttttcacaaaaggaaacatatgcttcctgctggccgaggcgacggacagctgggctgaaatgaatgcagccgtgggcggatttttaaaggcgtttcagcgccatgcatctgagcattttcagcggacgatttcttttggaatcagcaacctcagccatcagctgagagacgttccgcacatttgcaaagaagccgtcgatgcgctccactccggccatttgtcaggcagcaccgagttcatccagacgtaccatatgaaagacgtgtcagagcttttgcgcatgattccggctgatgatttgaagacattttacacgcatgcgctgcatcagcttgccagcctgccgaaggatgacccagggctcctgcaaacattgtccgtctatctggaaacgcactgtcagatttctgaaacggccaagcgcctgtacatccacagaaacaccgtcatctacaggcttgaaaaatgcgaggaactgctcgggaaaagcctgaaagatgcggacacgaccttgcgcttgagactcgcgctcagaattcaaatgctgcttgggttgtgagaaatcccttccccgcggcaatcggaggatgtaaagccgcgccggcatatttgatgatttgagcatttcaccataaaaaagccggcatatgtgccggctcccttatactttttcaggaattgtgcgcgcctgctgcttccgcccccagctgactgccgccaaaaagctgagcacgagaacgaccacaccaaaaatatatggaatttctacgttcacatcgaataacagaccggccactgtcggtccgacaatgttggcaaggctcataaacgcattgttcatgcctgcggcaaatccctgttcatctccggccatttttgaaatcagcgtattaatcgccggtcgaagaatggacgtcagcatgaagaaaacaattgttgccccgaaaaccagccagtacgaaccggcaatcgagcagacggcaagcgctccggcagaaccgatcagcgtcatgttcatcagctttttttcgccgaagcggttcgtcagcatcccgagagccaccgcctggacgaacacgccgatcagacttgccgctgttatgacaaaggcaatgtctcccggtgtaaagccgtgcttatgatcgacataaaggctgaataccgcctcgaaattcatgatcccgaagttcaagatgaacacgaggataaacagaaatgcatacggcgaccgcagcgcgcgcgccatttgcttagcgagcggttcgcgcttttgaacggagcggcgcttttcaagcatcttttcttgactgagcgtttccgggaggacaagaagcgataaaaccgtcgccaagccggctaatccggctgacacgtaaaacgggaaggtgagcccgaacgccgccaaatatccgcctgctcccggaccgatgacaaagccgagagacatcgcggcgctgatcagccccatccctttgcttcgatccttttccgatgtgatgtcagcgatgtaggcaaacatggccggcaccaaaaacgcagctcccgctccgccgagaaggcgggaaacaaacagcagccacatctggctcgccaaggcgaaaagcagctgggaaaccgcaaacgcaccgattcctaaaatgatcattttccgccttccgtatttatcagtcatttccccggcaacgggcgaaaacagcagctgggtaatccccgaagccgcgatcagcaatccgagcgtgctgcctgacgcgccgaattcttctataaacgtaggcatgagtggaataatcaagcctataccaagcatcacgataaacacgttaagcatgagcatatacaatctggccatctttttcatctgcggataccttccttcagcccgaaaataccggacaatcttaaattcgaacaattactaaattagtatatccacagataggtttaaagtctagttttttcatatttttgcatattttttcttctcaaggaatgatgggtaaataaaaaagcggagattcccccgcctttttatccatttacgaccagccgacagcgttagcaaacatcaggaaaagcacggccgctcccatccagaggcaaaacagcggaaggatgaatcgcagccatttgttccaggcaatccggctgatcgcaagcgtcgccataaaatatcccgatgtcggaaagacgatgtttgaaaaaccgtctccgaattggaaggccagaatcgccgtctgccgcgtaattccgacgatatcagccaaaggcgccataatcggcatcattattaaagcctgtccgcttccgcttggaacaaaaaagttaaacagcatctgtgtaaagagcatcgccgtaaccgttaaatacgaaggaagctgtgagacagcatgagacaagccgtaaacaatcgtatccatgatctgcccgtcggccataacgactgctgcagctcttgcaatgccgcaaatcatcgcaccgacgagcacttctttaaaaccctcattaaaggactcggcaatgtctctcgaattcatgccggcgatgtaagcaggaatgatgccgagcgccaggaaatagcccgccattgtcagcatatcccacctgaaataaattacacacccaatcaagccggcaaacaacccaagcgccgcgatcccggcccatttcacccgtccgcctgctttaaaagccggcacgggttcgactgcttccttgcccgtcaggcttttttcaggatgcgctctgatcttttccgcatatttgagcacataaacagcggcaatcgccgtaacgacaacaaagatgaccgccctgtaccccatcccggaataaagcgggagaccggaaatcatttgtgaggttcccacggtaaatgggtttgtcaaagcgctcgtaaagccggcgatcgtcccgcacaatgcgattgctgctgctgtcatccggtcatatccgagggacagcagcaaaggaagaatgacagggacataaacgatcgaaagctcaggcgtcccgataaaacaggaaatgccggagaaaacgaatattaagacaggcgtaacgaaaacaggcttgttcctgaactgatcggccaacagacggacgccgagctcaatgacagatgctttcctcagaacggcaaaagctccgccaatcacaaacgtaaacacaataatcggagccgcttctgtcatccctttcggaaccgccgtaagcaagccaagaatatcaaccggcgtctgttcgacccgtttgtaggacgctggatcaatcatttccctgccgtccggactttccacccgttcatattcgcctgccggaatgacatatgtcgcaagcgccataagaccaatcatgacagccagaatgacataaatatgcggaaattcctttttgcgtttttcgttctttttcacctcttctgttttgtaagccggcattcccattttttaatctccccttcttccatgttaaattttttaacatattaaatgatcgcagcgctgatagcattgaaaaatcctctaaatttcagcgtgttttcagttaaaatacataaatcaacacgagcaatccagaaaatcgtcacattttctatcaatcattaagctgatcatctcgactgttccttttctgcattttcatgtaaagtcataagaaagatcagcatgtaaaggagagagttgacattgcagcagtggattaaagaagtggccagaggaaaaaggggcgcccgggatttaacttatgaagaggccagacaggctgctgaagcgattgttacgggaaatgcaagccccgctcagacagccgcgttgttaatagcggagaggatcaaaacggagtcccctgaagaattgttcgcgtttaccgaagcattgcggaacagctcggaatcattgagcctttccagagctgtaaaagaggcggtcatcgattttgcaggaccttatacaggaagacattcttttttagcaaccattcccgtctccctccttctcgcaggaaacggcgttcctgcgtttctccacggcagcgatgcattgccgcccaaatatggaacgagcgtaaaagatgtcctggacaaactcggaatcccctctgagactgccccagcgcaaacggcacgctcactcgaaaaggctttaatcggattcgccgccgccgaaacattttgcaaaccgtttgttcgcatgaggaaaatccgcgaggaaatcggcgtccgcaccgtgttgaatacagcagaaaaactggtcaacttctctgatgccgacaagcttatgatgggcgcatttcaccggacggccatacagaaaatgcatcccgtatttcagcgcttgacgtacaaagaagtgttcattgtccaggggcggagggctcggaagatgtgccggtccacagaggcagctttgtgtttacaataaaaaacggcgagatcgattcttttatattaaaacctgaagaatacggactttacgcagaggaagcaaagctcaacaaaccgctgtctgctgaagagcaggcggaaaaaataacagccgttctcgccggagatgaatcggcggatacggaatacgaaagaaaacaagtcatcatgaatgccgcattgcgctattatttgttcggatactgcgcggccattgaagaaggtgtccaagcggcggaaaaacagctgaaagaaaaagccggtctggaagctcttgaaaggtggaaagcttcatttacaagaccgtaagaaaaccgtaatcaaaatgatatttccttttcatgaaaagattggataatgaaagaaatgaaaaggaggggatcgatagatgaaccgaaagtgtgtcattccgtttattttgatgttgtcggcgatgtgcgcgcccgcccaaaacgcagaggccttccagctgttttccttacccgtacaatcctcggctccggcagattactacgaacaggcgcagggcaaaacaggtgaagctttaaaacgagcgcttcacgacacaatcgacgatcatcgagagctgtcttacagcgaggtatgggaagcgctgaaagcaacggatgaagatccggccaatcgaaacaacgtgatactgttatattccagagagtcgcgctctaaacaggcgaacggggggcaaacgggcgattggaaccgcgagcacgtatgggcaaaatcgcacggtgatttcgggacaagcaaaggacccgggacagatttgcatcacctcaggcccagcgatgtgcaagttaacgccgcccgcggaaaccttgattttgacgaaggcggcagcccctatcccggagctcccggaaactactatgacggcgattcctgggaacctgacaaaagcatcaaaggcgatgtcgccagaatgattttctatatggcggtccgctatgaaggggacgacggtcatccggatcttgaaatgaacaatacaacgaacaacgggtctaaaccgtaccacggaaaaatgtcggttttattgaaatggcatcatgaagaccctgtcgatgccctcgaaagaaagcggaacgatatcatctatcagcaataccagcataaccgcaatccgttcattgatcaccctgaatgggcggaggatatttggggctcgggcgttttgaattgaacaaaaaaagcgcctgctcagcgctcttttttcaaacctctgtttttttgttcagcaccgattttttatccataaaacgaaagaaatctgctgtgcagcagccgcgaggcacggcttcatgggccgattatctacactgacagcccagatcccgcagtctccgttcaaacagccgagctcaatccgagccttcctccacgcacatctaaaagcgtgtcggccggcttgatggaagccggccttttttctccgttcatctcaagggttacttccatccttttagcgctttgtcataaggtttcctttttcagcatgccgagaatgtcaaacagagtatgtttgatgacaaacgtgcggtactctgcggaaccttgcgcatcgtccaatacaggaccgggcaggcggttgatcgcctcttccaccctttgaccaacagggagtgcctcgtcattcaacgcagattccacttcagcggagcgaaacggataagagcagacaccgctgaatgcacagcggacgcgtccgtctatttcgagagccgaaatcgttgccaaaggatatcccgtatcccatcgctgcctcacttttatgcttgcaaaaggctgatgaagatagcgttcttcaatcaaaagcgaaatgaggatttctcccttgctcagcttcagctgctgatcaaatacgtcgtgaatcagatagcgctttttccccttgtctccaactgtcaccactttgctgtcggttaataaaaaaggcagcaccgcttcgcggtaaaagatctgcccgcaaatattgccgccaagcgtaatcttattgcgcgccgtatggtcggccacctctctcgccgctttgctcaacagcggaaagccgccgttttccgtgatctccgtcagtgttagcgccgagcctaaagcaaggtgatgccgttcaaattgcaaagtcctgcactcaggtatatctttaatatcgatgacggcatttgtatggatcacattcatccgtccgagcatcaactgttctgttccgccggaacaatacgccggctttttcccctcccgctccaggctttgaaagagctttaccgcttcctgcgcagattgggggctgtaatactcaaagtcaaactggatcatggcggtcctccttcattttccaaatttgtttggaatcagaggcagccgattcaaaaaaccggcatgcacttcaaataaagccagctcattcacccaaaattttactccatgaatttatattgaacaatattctattttaaaactgtaaacaagaaaaaagttcactcgaagctagagtgaacttttttctgcacgttgattcaactttcaagcgcgccggccggatcatataaagcgatatcaagctcaggctcttctcccaaagcgagccttgccaattcagcgccaaggtacggacctgacgtaagccctgaagcgccgagaccgttggcaacgaggagcccgcaaatgttcggcaatgagccgatcacggggagaaagcccggtgtaaacggcctgaagcctacgcgcgcctcaagcagctcgctcaattccaaccccggcgcaacggcgagcgcctttgagaaaatttcgtgaaggccgccggccgttacccgaagatcgtccagttccgcttcattttcgtgagtagcgccggcaacgatccggccgtcttcaaatgccagtatgtattggtcattcggaggcatcacaacaggccagctgccggtatcggcatcaggaagacaaaggtggacgatctgcgctttttggtagctgactgaaaaacgaacgccgagcggcttcaagagctcgtccgcccaagctcccgctgtgacaagcacctgatcagcgtatattttcttgccccctgtggagatccctgttacccggtttccttcatagagcaatgaagcgtttcctgaaacaacagaagctccgtatttttttgcggcattcacaagtgagcggcgcagcaattttccattcacgcgcgcggctccgctgatatgaaccgagctgtacccctctgccaaaggcggaaataaacgcttcgtttcctcatgggataaccgggtgatctcgccgatttcgggcgcatccttgcgccttagatgcgcccgttcttccattttctccagctttcgctcgtctgtatgcaagctgatagcgcctgtccgtttataccccgtatccgattctccgtcagcttcaagctgcttgattaaatcggcatagtacgccgcaccgccttttgcaagcttgtaccatgcctggttcctgcgctgcgaaagccaggggcagacgattccagccgcggcatctgtagcccttccccgctctccgcggtcaatcaatgtcacatccgcgcccttttttgcaatatgataagcggctgaagcgccgaggatgcccgctccgactacaataaaagatttcatgactaacacctttttcatttctgtttattctacaaatataacggatcacaccgatggagcacaacctaaccagcggctaccgatatcacgccaagcaccattaaggcagccgcgatgatcctcagtcgtccgaaaccttcggacaaaagaaccgcccccatcacggttccgattaaaatgctgatttcccgaacaggcgccacatagctgaccggggcaaataccatgacactcagcgccaaaatataagccaaagaattaaaaaccccgaccccgacagcttccatccggtgatgcttccactcaaaccggacttcactccagcttttcgcggcataaggagtcaatatgaccaggcggccgagcgtattgcaataatccagcagcaatggcggaatgagaaaccggctgaccgctgctttatcaaggagagtatatgcggcaataatgccgccgaccgccagcccgtaaagaaccggtgtgaacgagcctgattcttttaaccgcttcactccccctgtaaaaaaaagaatgctgatcacaatcaatagaatccctataatagcgggcagcgtcaacgtctcgccaaaaaaggcgaccgccagcatgcaggtgagcagcgggcctgtccccctcgcgatcggatagacaagggagagatcgccctttttgtatcctttttgaagaacaagaaaaaagcccaagtgagcaaggatgctcgccatgatgatgacaagctgccagatgccgatctcaggcttttcatatatgacgacacctatggccaacggcgtgtagatgacggctgcaatcgctgtgaacagccagataaacggaacgcctccatcggcttttttagaaagatagttccacgatgcatggataaatgcagaacataataatacgcaaaaacccacgacagtcattacacagccctccgtccatcataaaagagatcaatgcttgatgacaatgtagcgcttcaattccccgtgccacttctttcctttgacggcatccacccagacgtcatacttgcccggtttcagctttttcgtcggaaagctcacccgaaaatgaggctttccgcgcgttaaatgaacatctcgatagatcaggacagtcccttttttattgatcagcctgacggcaatcatcgttcccgtaacagggctttttccagtgacaacgatcgaagtggctgatttcgtatatgtattggcatccgtcctgaatttcaccgcgcctttggaaggcatagcaaaggcttctgtactcccggcaaatgcggccagcaagaaaacagcggctatcaacacagcctttttcaacattttcactggtcatatcctttcttatacagtatgaatgtcacatgctatacccttcattatacatgacaatatgatctaataaagatatttgacaagaagatcctgttcttctttaatggacaaatactgtataaaggaggtgatttaatgtattaagcaaagatgaaaaaatgaaacccgcatatagaagaagttactgttgaaatacaaggctatgaatttaccggcttttcaactgtctgtcccacttttatagaagagggtaaagagtatcccgtcatgatcaaaatttaccattttctaatcatgaagcattccccaatcgtaaaacctatgataaagaccgcgcaagctgaggagtaattcggattttccattgacacctcgcaaattgcgaatccggtccccacttccaaaagaataaacagataagatacgattctggattttaaatagcttgccatagaccgacctttctttctgcgattacttaaaataataatcaagtaatcaaaatttgaggttttaataatgctgggggaaattcttttttatagtaagaaatcctgctgctttaactacccctagaacgatttagtttacatgtagaaaagcactcctttgaatttgtcttctcgcattaactgttatccggtagaattccactgcatctcgaattttttcttttttctctaatagttcagccgctataagaccgtattcctccatgtctgcatacttgcctttactttcgaaaaacttgaacgattcgcgaaccatatccagatcaaatgaaagataaagcccttttattaaatcaaactttgcaagcatatctaaattcttgttcttttcagccaactctttgccttcatagtataggtcatcagttattgacaacttcccttgctttgccctgacatgtgcgaggttgaataatgtttttggcaaaaaactatgcttctcctctttataaaggttcagagctctttgaaaattgtaggttgctttatcgacatcttccaatttattgtagcatattccgatatttaaatgtgatgaacccataagatgaagaattccttgtgtctctgactctttaagctctttatttaaattatgtagagctttttcgggatacatatgatctagccagttacctgcaataataaactgactttgtactcgacgctcaccgtaagtatcatactttttgaataagttatacgcacgacttgcataattcatcgaaaagatggtttgtttcatatggtaatacacttcagatgccttgaaataaaattcagccttttccagttcatcacaatcaaaagaatcgagttttttctcggcatccctataaaaattcagcgcaaggattaattctttttgtctgaaatgatacattccagcgaaaaaatgataataataatccaacattccttccagattattctgatcgcgaatctttttgaactcatcaaaacgactatttaaatttacaccgggtttagaatacatataatcaagttgaagattatgccggaagagcagtaagttgtaatagacaatcacatcctgattttgttccatttgttctaattctcgttcaacttctttcttagtatcctcagccttgcctgtccaattgttttttaaggctgtataccaaaaattcattttcgtcgcaaccaaatcatatggtatcacgctcacatatcctcttcctttctcgcaagattataatttttctaaaaacccaaaatagcaattcccttttgttcatagtcatcattttacataaaaggaataatttttcacaacaacattctcagaaatctttataagttagaggttttttggcctaatcaatatgattcgttttccgtgtttgggtgaattttagaagtataggaaggaaggcagaacagatgaaggattatattttcctgttgatatgtaatttggcataactaatcgttaggaagcaaaattcaaacctcttttatgaaataaaaagctaaagaaaaaaccgcagatacatttctacgccttttagaaaatcgataggcaatagattatatctgcggtacacaaacataaagtttattcgggtgcaatcaaatcgaaatctgatcaccccctttagtatcaagggttaaccaatagacccttccatctcgaacttgataagacggttcatttcgactgcgtattccatcggcagttctttcgtgaacggctcgatgaagcccatgacgatcatttctgttgcttcttcttcagaaataccgcggctcatcaagtagaagagctgctcttcagatacttttgatactttcgcttcgtgctccaatgaaatgttgtcgttcaaaatttcattgtatgggattgtatcagaagttgatttgttgtccatgataagcgtgtcgcactcgatgtttgagcgggcgccttcggctttgcgtccgaagtgtacgattccgcggtatgtgacttttccgccttgttttgagattgattttgaaacgattgtggatgacgtattcggtgcaaggtgaatcattttcgcaccggcatcctgatgctgtccttttcctgccagggcgatagaaagcgtcatgccgcgcgcgccttcgcctttcaggataacggcaggatatttcattgtcagcttggagccgatgtttccgtcgatccattccatcgtcgcgttttcttcacaaaccgcacgctttgtcacaaggttgaagacgttgttcgcccagttttgaatcgttgtataacggcagtagccgccttttttaacgatgatctcaacaaccgcgctgtgaagggagttcgtcgtataaacaggtgctgtacatccctctacatagtggacgtgagcgccttcgtctacgatgatcagcgtccgttcgaactgtcccatgttttctgagttgatgcggaagtatgcttgcagcggagtatccacttttacgccttttggcacgtagatgaatgatccgcctgaccataccgctgagttcaaggccgcaaacttgttgtcagtcggcgggatgacttttgcccaatgctcgcggaaaatgtcttcattttctttgagggcgctgtctgtgtctttgaagacgatcccttgagactcaaggtcttctttcatgttatggtaaacgacttctgactcatattgcgcggatacaccggccaaatatttttgctcagcttctgggattccgagcttgtcaaatgtctgtttgatttcctcaggcacttcgtcccatgatctttctgaacgctcagaaggctttacatagtatgtgatttcatcaaagtttaatgagtttaaatctccgccccattgcggcattggcatattgtagaagtgttcaagagatttcaagcgaaagtcgagcatccactgtggctcttctttcatgcgtgaaatttcttcaacgatttcttttgtcaatccccgctctgaacggaaaatggaaacgtctttgtcggcaaaaccgtatttatattcgccgatatccggcattttcttagccatccattttcactccaatctttattcgttatcgctgttttctttggaaacgcctttttcgagggctttccatgacaatgttgcgcatttaattcgggccggaaattttgaaacgccttgcagagcttcaatatctcctaaatcaatcgaatcgtcgtagtctttgccctgcatcatatctgaaaagatccgtgacatttgaagggcggtctccacgtctttccctttgatcgcctgtgtcatcatagacgcagaagccattgagattgagcatccttcgccttcaaattttgcatcttctactttaccgtccgttatcttcatcgtcagcctgatccggtcaccgcatgtcgggttgttcatgtcaacgacgatgctgtcattcaaaacccctttatttctcgggtttttatagtgatccataatcacctggcgatacagtgtatccaagttcacattaaaagacatttgtgaaatactcctttgtcttctgaagagcttcaatcagtttgtcgatgtcttcttccgtattatacagataaaagctcgctcttgcagtggcggagacgttcagccatttcattaaaggctgcgcgcagtgatggccggctctgacggcgaccccttctgcatccagcacggttgccacatcgtgcggatgaacgtcttcaaggttgaacgtcacgagtcctgcacgttcggccggaccatagacaacagcgccttcaagctctttaaagcgctccagcgcgtatgccgccaaacggtgttcatgcgctaatatttcatcaagtccgatgtcttcaaggaagtcaatcgccgctcccaatccgatcgcgccggcaatgatcggtgtgccggcttcgaatttccaaggcagctccttccaagtcgattcgtaaagaccgacaaaatcgatcatttctccgccgaattctgcaggttccatgttttcaagcaatgctttttttccatacaataccccgattccggtcggaccacacattttgtgggctgaaaacgtatagaaatcgcagtccaaatcctggacgtcaattttcatgtgcggcgtgctttgcgcaccgtctacgaccatgaccgcgccgtgttcgtgggcgattttggccatttccttaatcgggttgatcgtaccgagaacgtttgaaacatgcgctgcagagacgatttttgtattttccgtcaccgtttccctgacatcgtccaaggaaatggtgccgtcttcctgaagcggaatgtacttcagcgtggcgccggttgctttgacagcctgctgccacggaataatattcgcatggtgctccatcggtgtaatgacgatttcatcaccgggcttaaggtttgcgcgggcatagctgagcgcaaccgtgttcagggccgttgtcgtaccccttgtgaaaataatttcctgcatcgatttcgcgtttataaacttcctgaccttctcacgtgctccttcatatccatccgttgcttttgttcctaatgtatggacgccgcgatggacattggaattgtaagagttgtaatactcatcaagcgtctcaatgacgacgcgcggcttttgcgaggtggccgcgctgtccaaataaacgagatcgtgtccgttgacctgttggctgagaatcggaaactgttcgcgaatatctttagcattcattattttactttcctttcaatcacagagaccagctgcttcttcacgccttcaatcggaagttcattgacaaccggtgcgaggaagccgtaaatgacgaggcgctctgcttcttctttaggaattccgcggctcatcaaatagtagagctgaaccggatcgacgcggccgacagatgcagcgtgtcctgccgttacatcgtcttcatcgattaataggatcgggtttgcgtcgccgcgcgctttttcactcagcataagaacgcgtgactcctgctctgcatttgattttgacgcgccgtgctcgatctttccgataccgttgaagatcgaagacgcggaatctttcataacgccgtgttttaaaatatagccttctgaatgctttccgtggtgaatgatttgcgttgtaaagttttgagtctgttctcctctgccgacgacaaccgttttcgtatcgccgaatgtgccgtctccatgcagattcgtcgtgttttcagaaatggtgtctccgtcattcatcaaaccgagcgcccattcaattttgctgtcgcgtccgagtgcagttccgcggcggctgacataagccgttacccctgcggaaaggttgtcgacggctccgtattgcacgcgggcattcgcgcctgtgatcacttctgacacgatgttaaagaccgcttccttaggattcaccgtgctgatgtagttttctacatatgtgacggcactgttgtcatctgcaacgacaagtacatggttgaaaagcgttgtatcgttgctttcatggacataaacagcctgcaccggagcttccagctcgacgtttttcggtacgtaaaggaaggctccgccgttcaggagggctgcatgcaatgcagttaatttatgctcatcggcttttacgccgtctttcataaagtactttttgacaagctcgccgtgttcgcggaacgcagtatgaatatctgtaaagatgacgcctttatcctgcagctcttttgaaagagaaaggtaagccggcgtctggtctctctggacataaagcgttttgtcttcatttccaagatcgatcagcgatttgacctcatctgaaagatcatccaaagaatcaagcggtttattttctacagtatgcttatcaaaccgtgtaaaattccaatttgtaatttttgttttatcaggtttcggcagcggcagatcttctgctttttcaagcgcttctaagcgtagatcttgcagccatgccggttcctggtgcttctcagagaagcttttgacatattcccgatctacagatagttttgtttccaatgtcatgtttatccccctaacgcttacgcttcttgaccgacagtttcgtcttcgattccaagctcatgcttaatccagtcatatccttcagcctcaaggcgctgtgcaagttcaggtccgccggatttcacgacgcggccctgcatcatgacgtgcacatggtcaggcgtaatgtagttcaagaggcgctgatagtgcgtgatgatcaggcagccaaagttctcgccgcgcattttgttgattccttttgaaacgactttaagggcgtcgatatccaaacctgaatcgatttcgtcaagaatcgcgattttcggttcgatcatcatcagctgaaggatctcgttgcgctttttctcaccgcctgaaaaaccttcgttcaggtagcgctgcgccatatcagggtccatttcaagaaattccatgttttcgtccattttgcggatgaatttcattaaagaaatctcgtcgccttcttctctgcgcgcgttgatcgctgaacggagaaaatcggcatttgtaacaccgctgatttcactcggatactgcatagccaaaaacagaccggcttgagcgcgctcgtccacttccatttccagaacgtccttgccgtccagcgtgatgcttcctttcgtcacttcgtatttagggtgtcccatgatcgccgcggataaagttgatttacccgttccgttcggtcccattacagcgtggaattccccgccttttatttcaaggtttacaccttttaaaatctctttcccttcaatctcaacgtgaagatctttgattgttaatgtcgaagcagccatgaaatatacctccaattatagataatcatcattctcaatttattctcattctaattttataacaaatgaaaattgaatacaacaatagtcttcctatcttttcgtgtacatgttctcaagtttaacaaaaaacgatttgttcttaaagagattgggacaagaaaacttcccggggcagaaaagcggaatttattaccaagctgtcgaaaacaatcggtacatccgtcattaagagcggggatggtttgctcccaggctgcacgattcatgaggggaacagcgctccccttctatttgaaccgtcacatgctccacgttgcattctttccttagatattttgatacttgttttaaaattctatccctgtcactgttttcatccgctacgatatggcagcttaatgacggcatatcggatgagatcgaccaaatgtggaggtcgtgaacctccctgaccgacgggatggaaagcaggccgtttttaagcgcctccgcatcaatgtctttcggttttccttccattaatatatgcaccgagtctttcgtcacccgccagccgctgacgagaaccaaagcagcgacgacggcgctggcgattggatcggcgatgttccaattgaagaaaagcataaggaggcccgcgatgatcgccccgaaagagcccagcatatcgccgatgatgtgcaaaaaagcgctccgcatatttaaattcccgcttgtgtcgcctttcattattacccaggccgcagcaatgttgacgaacagaccaaccgtcgcaatcgcaagcataccccttcccgcgacttccggcgggctgaaaaagcgattgtatgcttcccaaaaaatataaagtgaaatcaaaagcagggtgatgccattgataaacgcagccaaaatctcaaagcgcctgtagccgaatgttttgctcgcgcttgcggccttttccccaattttaaacgccaagaggctgaagccaagcgccgcagcgtcgctgagcatatgtcccgcatctgacagcaaagcgaggctgttcgtcaatattccgcctatcacttcaatcatcataaaagtaaaaattaaaccgaagctgatgaacagcgctttttgatttgctgatcggctgccatggtggctgtgtcctgtatgtccgtgagaatgagccattttaaatcctcctcttaaattgatatatgatcatgtattcatatttaaattttaccttttcctttaattaaggtcaagcggcttctaagaacatggagaaggacggatcggcatccgtccccctcgcgttttatccgattatgggcaagtctgatacgatctgcttgcttttttgatactgcttttctcgtcttttctcaacttcaagccgattcacatggcttctgctgtactcctcgtaccccattccatgcgacttgtgcatcgctttttccatttcggccgtgaattcaaggtcaagctgatcttggcttgaacaaataatgaatcatcctttcagagattttcttacatagtaccagttatatacaaactctgcaaagatgtgtgtgctttcaatatgctttcacggtcgaaaaatcaatgcttcatctgctggaattcttccatcgcctgcaaaacgagcgtgacggcttggctcatggctgcgcctccgccaaatgcagcagttacaccgactgcctcaagaatttcttcctccgatgctccgcaatccaggcagcccttgatgtgataaataatgcaatattcatcctgcgtattgacactgatgcccagtgcgatcagctgcttatccttttcgctgagcacgccttttttaaagcactcttcggtaaattcgttgtatttggcggcaattccgggcattttttcggaaaagatgccgatccccgccttatattcgtgcagtgcggattcgataatgccttctgattcatgctgattcacgttttgttcctccattttcagtaggtagtcttttttattatgagcctcttttcaaaaaatacgcgaaaaaaccccggttttctccgaaaccggggtgttctttcatttactcagatacagaaatgacagagcctttatattttttgtcgatgaactttttgatgtcgtcagagcgcaatacttccatcagagcttttactttgtcagaatcttcgtcgcctttgcggacggcgatgatgttagcgtaaggattgtcttttggagactcaagttcgattgaatcagttttcggattcagcttgttttggatcgcatagttcacattgatgaacactgcgtctgcttcattagcttcgtatgcttttgccgtcatttcaggcgccacatcatttttgattttcaggtttttcttgttttctgtaatatcttttactgtcgcatctactttttcaatgcctgatttcagcttgatcagtcccgcattttcaagcattgcaagcatgcggccctgttcagcggcattgttgctcataataatttttgcaccgtcaggaaggtcttttaaagatttatactttttagagtaaatgccgaatggctcaaggtgtaccgcaccgacgttgactagatcgtaatctttgttttctttcatttcctgttcaaggtaagggacgtgctggaagtagttcgcatcaagatcttttgtagcgagcgctttgttgatcagtttgtagtccgtgaaatttttgattttaagctcatagcctttttctttcaaaagcggttttgcttcttcaaggatttcggcgtgaggcgtcggcgtcgctccgactgtaatgactttgctgtctttatctccttcgctgctggaagatccgcaagcggccaaaacgcctgcaaaaatgatgaataaagctgttaataaaccttttttcatgttggtgtcctccctaacgtttgtctaatttatttgttataaaatccccgataaattggatgatgaacacaatagctaagatgaaaatagtggcgatcagtataatatcgggattgttcatctgaaagccgtttacataggcaaggttcccgagtccgcctgaaccgattgctccggccatcgctgtcgaaccgatcagtgcaatggctgtaaccgtaatgcctgagatcagcgccggcatcgattcgggcaggagcactttaaatatgatcgtcgatgtttttgcccccatcgatttcgctgcttcaatcacgcctttgtcgacctcgcgcaaagcaatttcaaccaggcgggcatagaacggagcggatgcgataatcaaagccggaagagcggcattcggccccagaatcgtattcattaaaaactttgtgaaaccgagcagcaaaataatcaatatgataaaaggaatagacctgaacacattgacgattgccgagattacaccgttaacgactcggttctgccaaatgttgccttttgaagtcaaatagagcagcatgccgagaatcactccgatgataaaagcaaacaatagggaaattcctgtcatatatatcgtttcatacgttgcttcccacagctgctccatatctacgtttggaaacagtttttcaaacattcgtgatcacctctgcttctacctggcggctcttgatgaaatcgaccacgtcattgacctcgttttcacgtccgtcgacatgtatgaacaatgaaccgtatgcaccgtcctgagtctgcgagattttgccttgaaggatgttgacttcaacatcgaacttccgaatgatctgcgtgatcagcggcgattcggccgcttcgccgacgaaagtgagcttgatcgtccgcccggatgtcgtttcttcgaggaaatgcttcagcgtttcctttgtttccaccggttctgttacctgctgaacaaagcgctttgtcatttcttccttcggcttgatgaagacgttcagtacatcgccttcttctacgacctttccgttttccatgacggccactctgtggcagattttcctgatgacatgcatttcatgagtgatcaggacaatggtcagtccgagcctttcattgatatcggacagaagacccagaatcgaatcagtcgtctgcggatcaagcgctgatgtcgcttcatcgcataacagaactttcggattgtttgcgagcgcccgtgcgatgccgacgcgctgcttttggcctccgctcagctgtgaagggtaggcgttttccttgccttcaagaccgacaagcttaatcagttcagcgactctttccagacgttttgctttgctgacaccggcgatctccagcggaaacgcaatattgtcgcgcaccgttctcgaccataacaggttgaaatgctggaaaatcatgctgatttcctgccttgctttcctcagcttcttccctttgatctcgctgatttttctgccggctacttcaaccgtgcctgaagtcggctgttcaagtccgttcaagagacggatcaaggagctttttccggctccgctatatccaataattccgaagatttcaccttttttaatcgtaagggtgacatcttggacagcattgacatctccatgctttgaccgataaatctttgaaacattttgaagatttatcaaaagccatcacctgctttcttgctcaattctcatagttgtctaaattcctgatcaatcaacgaaaaaagcctttctgcacacatgagcagaaaggctttggaaaagtctgggcctttctctcatctttcaaagcataacgcttcgcgtgaattggcaccatttcaacacgtgttgatggttgccgggtttcatagggcacttccctccacctctctggataagagaaacatatatttattttttgattattatgatcggaattcttaaagtaggatatcatgcgaaaaaatagttgtcaactatttttcgtaagacaatcgtcctacggcgaaaagagacgagcgtaaacgcccgtccctgtctgactaatacacggaatgtgccgattttttgaatttttaaaaagtctatgaataaagatcgctgtttttaaagaagccgtccgtcagccataaaatcgcttcaagcttcaataaagctctaaaagagccttttactttaacagtgccgcgctgtacgagatgctgcaatgaaatgtcgccatgaagaaggtcaataatctcgctttgctctccaaaaaaggtcaaatgagctttttctacaggagaatatttttccatttcccctttttcgttgattgctaacgtaaaagcttctttctctccttgaaacgtaatcagcaaagccgttgtagataatagaggttttaaaaaaagagccttgccctctctttctatcaatcccattttctccaactgtataacctcctgtaaattggtcatacttacagattctctgtctgctgcaggagttcctttaggaattgctcgacaagtttttgctggttatttcccgagaaatttgtcaaaaccgcccttaatccacaagattttgtttaatcgtatcatataagtaggaaacggagtgaaaagcgtattcttttttgacgactcgcccttttttgtaaaggataaaacacgggacgctttcaatttcctgctgtttggcaaatgacggggagtaattgagattgtttttataaaaaggaatgtccttcatcatttcatcaacgacctccagcattcttccggccagctgacacgttccgcagaacggcgtgtatacatatagaagacaagtttcatgctctagccgttttagctctttttcttgaagttcttgcatctgttgaaccgcacctcaatacgttttataatagatattttgtatgtacccggatgtttgaacgaaataatacttctgcaacatgctgactcggggcggaagcgacttctttgtatactctatcaatgtatagatgcgaagcttggggaagctccctcttcagctgccggcggagcttttcgcctgattcatcggcatccaccaggatataaacgtctttatcgaacagcgtctcagcgaattcatcgagttttgcctggctgatcgttccgtttgtgcatatgatgtccacgggctcttcgatgacatgcttcactttttgcttatctgatttcccttcgacgatcatgactttttcattttccggcatatggatcacctttaaagatttacttgtaaaaaaaggcagtgaatattcaccgcctgacttgattaacaccagccttggtggtcatcacagtctacatatttagcatccggtccgcttacggtatccgccattttgtaaaacttttcatcttggaatgaatatccagatttcaactcgtattgatccttgccggtcattcggccgatcagctcattttcatgatacagctgcgttccgccgttttttaatcggctttccacatgttctgtaatatcaatacgttcttttttcagcgtcaatttggacaccccctcctgatatagagtatccaaacgacgaatgtctatcctgtttagtcttcttttatcatgtcctcatattgcccggctgtcatcaggttttcgatttcagaagcgtctgacggctcgacgacaatcatccaagccttttcatacggagactcgttgacgaattcagggctgtcttccagatcttcgttcacttcgaccacttttccgttgatcggggcatacagctcagaaacggtctttacggattcaacgctgccaaaaggctcgtccgctttgatttcgtctcccacttcaggaagctcgacaaatacgatgtctccaagctcagattgtgcaaagtctgtaatgccgattctgactttatctccttcggttttcacccattcgtgttcttctgaataacgcaactctttcggtgtgctcatgctaacccctccataaagtgttttaatcgatcctacattgaagatatcatattttgatgtgttataaccagtatgtcttaaactgatcttctttaaaaccgaccgttactttactgccgtctgtcgtaattgggcgtttgatcagcataccgtctgatgcaagcagttccagctgctcatcttcagacatgctttgcagcttgtctttcaggccgagttcgcggtatttttggccgctcgtgttgaaaaacttcttcaattcaagcccgcttttctcgtagagctctttcagtttttccttgctcggcggctgttctgcgatatgtatcccattgatttcttttccgtggtcttcgagccattttttcgctttgcggcatgtcccgcatttcggataccagtaaaaatccaaagccatacatacacccctctcatttaatcgaggtaattttaacatagatcgaatgaaaaacctaaaacagtgctcgggttctattaacagctcagaaagccctgcattaaagcagggcttctcgtttaaacgatatatttctcagcttcaaagactcccttggctgcctggcgctttttctcaatcacgttgacaggcgtaaagcgcgtcaatttgcgcagcgcggacagcatcatgcgcagcgaatcgcctgattccatcgcaatgagcgattctttggcatggctttcaatttcctgaaaggcttcctgcgcaaaaatttgcgtataaagaattttctgtgcgtttttgtcttcgccggttgcccggatggctttttcagtacgtaaaatagctgcttccattgcgtagatctggctgacaatgtcggcgatgttgacgaggatttcctgctcctggtcgagcgcttttccgtatttttgcgcggcgagtcccgcgatcatgagcgcggtctttttggcgtttctcagcagatacttttcctgttcgagaacgccgtcacctggttcttcaggcatgagcatcatcagttcttcctgaagagcctttgctttctcaaacagaggaagctcgcctttcatcgcttttttcatgtaggtgcccgggacgatgagccggttgatttcgtttgtgccttcaaaaatccggttaatccgtgaatcgcggtaagcccgctccacttcgtattcctgcatgaatccgtaaccgccgtggatttgaacgccttcatcaacgatataatcaagcgtttcagatccgaatactttgttaagggagcattcgattgcatattctgcgatcgatttcgcaacctggcgcccgtctttttgctcttcttcgctcaaggtgcccattttgtcttcaaacagcccgaccgtacgataaacagagctttccatcgcataaagtttgactgacatgttggcgattttttccccaattaagctgaactttgaaatcggtgtcttaaactgctggcgctgattggcgtatgaagcggacagctcgatgacccgtttcgaagcgccgattgtcccgacagcgagcttatagcgtccgatatttaaaatattgaaggcgatgacatgcccttttcccggttcacctaataggttttcttttggaacttgaacctggtctaagatgagcgtgcgggtcgaagagcctttgatgcccatttttttctcttcaggccctgtggagacgcctgagtagtctttttccacaatgaaggccgagaaatgttcgccgtctattttcgcatagacgatgaaaatatcagcaaaggctgagtttgtaatccattgcttttcgccgtttaatatatagtgggttcccgcctcattcaaaacggccgttgtttttgcccctaatgcatcagacccggagcccggctctgttaaagcataggctgcaaacttttcccccgttgcaagggacggcagatactttttcttttgctcctcggttccgaaaaatacgatcggaagcgtgccgatccctacgtgcgccccgtacgataacgaaaagctccccgctcttgaaaatttttcggtgattaacgccgagctgattttatcaagtccgagtccgccatactcctcaggaacgtcagctccgagaagcccgagttcgccggcttttttcagaagcctgacagaatgatcgaaattgtgctcttcaatttcgtcgatgtacggtagcacatctccgagaatataatcctcagtcgttttggcgatcattttatgttcatctgtgaaatcttccggtgtgaacatctgatcagccgttacctcttcgatcagaaaggcgccgccttttttcatatgatcttttgtttgttccattgttccatcccccttgtgattaaactaattcgaatacccctgctgctcccatgcctccgccgatacacatcgtcacaatgccgaattgctcgcttctccggcgcatttcgtggatcaatgtcagcgtcagctttgtacccgtgcagccgagcggatgtccgagcgcaatcgctccgccgttgacattgactttttcttcatcaatgccaagcgacctgatgacctggatcgcttgcgatgcaaacgcctcatttaattcgaataaaccgatatccgacagctcaagtcccgccatcttcagcgcccttgggactgcttccacagggccgatgcccatcacttccggcggaacgccgccgactgcgaacgaacgaaattttgcgaggggctttaacccgagtgcgtccgctttttctctgtccatgatcatcactgcggcagccccgtcgctcgtctgcgaggaattccctgccgtaaccgagccgtttgccgaaaacgccggtttcaacgttgacagaacgtctttggttgtccccgggcgtacaccttcatcggcagagaaagtaaacgtccgctccttcaggttatgatgttcatccacttctctgacggtgacgtccaccgggacgatttcatcttcgaactttccttccgcgatcgccttggctgctttttgatggctgttgacggcaaatgcatcttggtcctccctggaaacgccgtatttgacggcaacctgttcagccgtatggcccattcccatataatattcaggagccgtttccgccagagccgcgttcggtctgacgatatgacccatcatcggcacgatgctcatcgattcggcgccgcctgcaatgatcgtgtcagcagctccaagcatgattttttcggccccgtaagcgattgattgaagtcctgatgaacaatatctgttgatcgtaacggccggaactgtgtgcggcagaccggcaagcgcgccgatattgcgcgccatattcaagccttgttcggcttccggcgtagcgcagccgatgatcaaatcatcgatattcccttcataaccgcccgctcttttcagcgtctctctcaccgcatatgcgcctaaatcatcgggacggacagtcctcaatgagcctttttttgcttttccgatcggggttctcgcccccgatacaataactgcctctttcattattttccctcctaattacgcaaaggtttgcctttcacaagcatatgctgcattctcgcctgcgatttcggttcgctcacaaggctcagaaacgcttctctttccaaattgagcaagtattcttccgttacttcggcgccgaatggaactcggccgcccgcgatgacaaacgccagttttttcgcaatcttcatgtcgtgttcagagatggcgccggaaagttttaacgattcagcaccgagcaggagcgccgcatagccggtttcgcccgtcaccggaactttctctttcaccggcggacggtagccgctttcggaaagtgtcaggacgagttttttggcatcgtataacaagtgatcctgattgatgctgatttgatcctctgcggttaagatgttcagttctttcgcttcttgagccgaagtcgacgtttttgcaagggcaattgtctcaaacgtcttgatggcggcctcctggatatccggtttaacgccttcaggcagccctttcaagtaatttaaataaagctctttattgcctccgccgcccggaatcagaccgacgcctgtttcaacgaggcccatgtatgattcgcttgaggcttgaacacgggcagcaggcaggcatagctcagtccccccgccaagcgtcatgccgaacggagcagcgacgaccggcttggaactgtatttcactttcatcatcgtctcttggaactgacggatgatcatgtcaatttccatatagttgtcgtcttgagcttccatcagcatcatcgcgagattggctccgacgcagaaatttttgccctggttgccgatcacaagccctttatagttggcgtctacttcctcgagagcaaatttcagcatttgaatgatgtccaggccgattgcgttgcttttcgagtgaaattcgagcagtgcgacatcatcgcctaaatcgatcaaacttgccccgctgtttttcttgatgacgccttttgtttctttgagtgacgacaaatggatcgttttcttgttttcttgaagcgccctgtattcgccgctttcaaaacagtagtagaacgtctttccgttttccttaaggtagaaggtttcatgtccttttgcgagcatttccttcacccagtccgcgaccttccagccctctgcttcaagcttttgcaccgagcttttcacaccgatgctgtcccacatttcaaacggcccttccgaccagccgaatccccatttcatcgcctgatcaaccgccgttatgctgtcggcgatttcccctgtcagctccgccgaatatacaagcgtcggagctgtaatcttccaaaggaggcttcccgccctgtcatcggaataaacaagcgctttcaatctcgctcctgcgcctttcatttgcttggccgcttccagtcccgatgtttttaatgtttgacgcgcgctgtaggtcatcgtcatcggatcgagctcaaggatgtcttttccttcttttttgtaaaaaccttgtttcgctttgctcccgatccagcctttttcgagcatttgttcaataaattcagggagccggaaaacgtttttttcttcgcccgtgacttggttatagacatttttggcaacgtgtgaaaatgtatcaaggccgacgacatcgagcgttctgaaggtcgcgcttttcgggcgtccgatcagcggacctgtaatcgaatcgacttcgcctatcgtgtagccgcctttcagcatttcctgaaccgtcacaagcaagccgtaggttccgatgcggttggcgataaagtttggcgtgtctttcgcttcaacaacccctttgccaagaacgtcttcgccgaatttcttcataaaggacagcacttcgggctccgtttcgtcaatcggaatcacctcaaggagctttaaatagcgggccggattgaagaagtgcgttcctaaaaagtgctttttaaaatcagcggaccttccctcagccatctgcctgacggagatgcctgatgtgttgctgctgacgatgcttccttgttttctgtattgatcgacctttgaaaacacttgctttttgatctccaggttttcgacaacaacttcaataatccagtcggcatctttaatcttttcaaaatcgtcttccatgttccctgtgctgatacggctgatattcttctttgaagtcagcggagccggtttttgctttagcagcttttgtacggctgtccgtgccagccgattgcgcacatccgggtcttcaagggtgcggccttttttcctttcctcatctgttaattcatgcggcaccatatcgagcagtaatacaggaatcccgatattggctaagtgagccgcgatgccggaacccataacaccggaaccgataacggcggcttttcgaatatgcttgaccatgaaagatcctcccccacctttgaatgaatactcattcatttttactccaaaaaaataaactctcctgtcttctttcatcttaaaagattttggaagcgagttcaataacttggtgcaaaatttctgaatttttttcatcgggtatgatcttgccgtgtttacatgtttccccgcttttgggacaaaccaatagagaggaggtgaaggccttggtacgtgaaagaaaaaatccatcttctgccgcagtcagcgccgcaagcataaaaggcaatgcaggtccggattataaaaagacggatgcgggcggtaaacggacaagccaaaaccagcaatataaaaagcataatatggatgttcctgaagatcactaagcccctttaagcatccggtataaatttccgctgtgttaggaaatctaaaaataaacgctaaaaggaggcagacgcatgcagcagcaaggaatgacaacaccgccgccggtcatttcaacgaaggaccatctgtatttgcaggatatgctgaactggaacctgctcgcgatgaaaaaagcgcattttatggcggatcaatgccaggatcagtctcttaaaacagaactcgacagggtcggccaaatgcaccatcaccattacaatatgatattggagcagcttcgtcaaaatcaaacgcaaaacccgtcagcatacatgcaataggaggtcaatgatgaatcagcaaaaccaacagaaaatcggcaatcaggaaacccctgtcccaaagacgagcgcgatgaacgacagggattttgtcaacgaactgctgacaaccgaaaaatatatgacgtcagcatactcgacggcgcttaatgaactaagccatgaatcgctttaccaggccgtacagccgctgtttaacgaggcgcaaaacgctcagcgcagattgtaccaggtaatgtttcaaaacggatggtacaaggtggaggcagaagatgcccaaaaaatccagcagtcctatcagcagttccattctacactgcaagaccagtcgccttatcagcaaaatcaataaacaaaaaataagcagaggaatctctctgcttattttttctgattagccgcccggtgcgcttcattacgttctttaatctggcggattacttcttttatcccctgcttcgcatccggataagctccgttccaatgcttggcgaggggcggcatgcttttggcgatatggctgtagatgatccacatcttaacctgttctttcagttcttcgtccgtttcgcccaaaagcagttccgtatatttctcgaccagtccgtccagctgctccctgagtttttccactcacgacaccctttctttatgtttatttctcgggcatgttctgcatttgacgccgttttcgtctgttgcataatacagacagcaagtcgtgcgtgtccgatcctccgcatgctgtcctggataaaaccttttgagagggttttcgtcctcaccttcatcaaaaaggcctggctctgcttcgtaaagaagaaaacggaaatctcgcgccgcccgtgccttgagcttcggatcttcctgaagcatgtcgtacatccaatacagataaaccgcaatattttcccaaagaatgtgctttgaaatcgagaatgtctgtcgacaggcctcgatcatgccgcccaaatggcgcctgaagatatcttcggtcaattttttcagttcttcggtgcggtccccttcgataagctcagcacctttgtgaaaataaaacgacggcgtccatccttgatcatccgcttctatctcccacgatacggaagccgggtcggctgggagccgttttccgcaaaccgtaaacagatagaaatgcagcgcagcaagcatgccgccgcgcttaacgagcattgaagccgcaactttttgattcggagcgttcagcctgtcttttatagcttctgcataacggcctaaaaaatcctcatcaaggagcatgtttcctttaacagagaataaggagccggtctgcttcgttccaaggcggaaacgaagcaatgactcaagctcctcttttgttaaattaagcatgggactgaaccacctgctggacgatgcatcttccttttccgtacggaatgcagtgcggcgtgccgaaaagcggatctttcgtcacttcgcagtccatttcaaaaacgtcctgtacaagcttgcagttgataatggattcaggccggccttcggcatatatctttttatctttaatcgcgacgaggtgatgggcgtagcggcaggcgaggttcaaatcgtgcagcaccatcacgatcgtgcgcttttcgtgttcatttaattcaaacaataggtccagaatttcgatttgatgcgtcatatccaagtatgtcgtcggttcatccagtaaaatgatatccgtttcctgggcgagcgtcatagcgatccaagcgcgctgccgctggcctcctgacaaggaatcgactgtacgctcagccagttcttccattcttgtcgctttcaaagccctttgcacggcctcttcatcttctgctgaccattgcttcagccagttttggtaaggataccgcccctgcttaacgagctggagaacggtcaagccttccggagccgaagggccttgaggaagaatggccagctcctttgccacttctttcgtcggaagcttggcgatggagctgccttcgaggagcaccgaaccgccctttggcttcatcaaacgtgcgagagaccgaaggagagtcgacttaccgcagccgttgctgccgataaatacggtgatttcaccttttgggatcgttaagtttaactcatcaataatgattgtttctccataacctaagcttaacgtttctgttgaaatggcactcataaatgaaatctctccttttattggtttctgcttttatacagcaagtagataaagtaaggggcgccgatcgcggcggtaaacacaccggcaggcacttcaacgggagaaaaaagcgtgcggccgatgatgtcggcaatcagcacgagcaatcctccgatcagcgcggcaaccggcaagagggcgccgaatgacgatccgacaagccttcttgcgatatgcggggccatcaaaccgacaaaaccgacagttccggcaaaagcaacggcgattccggcaaaagcagtgctcagaagcaggagcaaaaagcggtttcgctgaaccgagctgcccgctcctgtcgccagttcttcgccgagcgtctggatattgacgtttctggcggcggctgccgatatcagcaaaaggacaagcgcagccggcaataaaacgttcacatcctgccagttggagccatatactgatccggtaatccagacgttcgcctgggacattctgtatatcggtccttttatcataaacaatgtcgtcagcgactgggcaagcatcgaaaatccgattccgatcaaaacgagcctgaaagttgaagagccgtttttatatgaaagaaaataaacgagcattccggcgagggcagcgccgacaaatgcggcaaccgggagccagctgatgctgactgtaagcgcattgtttttatcggaaaacagcattaaaaacaagacaacagcgactgaagccccgccggtcacaccgatgatatccggcgaagcgagcggattgcggatcagaccctggaggatcgatccggcagccgccagacagattccggcaaacagagcgaccaaaatccgcggcatcctgaaggacatgataatcaggtcatcgcccggatcacccatgcccaaaaacgttttcgcgacggctcccggcgaaataaaacgttcgccgatgccggcgctgaggacgacggcacaagccgtcaacaccaataggatcatgaacgaaaacagcgcttttttgccgatcaacagtgaaatgccgccttttccgattctcagcgtgcggtaatttttcatttttggaacccccttctcgcgatatagacaaaaatgggtgtcccaatgatggctgtcatgacgccgacaggtacttcttcaggcatgatcaggtaccttgcgccaatgtctgcggtaacgagcaggatggctccaagcacggcgcagtacggaagaacccagcgatggtcgtgcccgacgataaatttagcaaaatgcgggatgacaatgccgataaagccgatcggcccggccacggcgacagatcccccggctagcaggacaatcgaaaccgccatcagcgctttaatcagccacgttttttggccgaggctttttgccacttcctcccccattgttaagacattgattttggatcctagcaaaaagctgatgatgaatgcgggcacgatatatggaagaacggagaccaagaggctgaggtcgcgcccctggacagagcccgcaagccaaaacagcgcctgctcaagagctgcttcattaacggaaagcattccttgcgtcagtgatgagaacagcgctgacatcgccgcccctgcaagcgtcagcttgaccggcgtcagaccttcccttccgagagagccgacaaaatagacgacaagcgcggcaaaggctgcgccgaaaaatgagatccatgcaatcgcctgaagcgaactgacatgaaagaaaaacagcgctccaacaacaaagaagccggcgcccgcattcacaccgaaaattcccggagaagcaagcggattttttgtcatcgcctgcattaaagcgccggctaccccgagggaagcgccgacagttgcagcgatcagcgcgcgcggcaaacgcacgtttttgatgaccagatgttcattagagccgctgaagtccgtaaaagccttgtaggccatcgaccatgacgtattcgtataaccgtatacgatactggcgcaaacggcggcagccagcaccaaaataaacgacagtagtgcgattgttctatatttattcgttcttaagagcataaattaaaattctcctagtttgactgaaacatctactggttattgtatcagataacactgatcttgaaaatcattttcaattaacaattgacaaaattctgatcaaaaattatgatcaggatgaatgacttacatacctaaggaggacacacatgaagagatggtctattgttggatttatcgctttgttagcgatttcaattcttgcagcctgcggcggaggcaaagatgactctgcaaagggcggagagaataaagatacgatcaccgttaaacatgcaatgggtacggaagaccgagtgcctgcagacccgaaaagagtcgtcgtcctgacaaatgaaggaaccgaagcgcttttggaactcggaatcaaacctgtgggtgcagtcaaatcctggacaggcgatccttggtatcagcatattcaagccgatatgaaaggcgttaagcaagtcgggctagaaggcgaaccgaatatcgaagcgattgccgagctgaagcctgatttaatcatcggaaataaaatgagacatgaaaaaatatacgacaagcttaaacaaattgctccgactgtcttctctgagacgctgcgcggagaatggaaagacaacttctctctctacgcgaaagcggtgaataaagagaaaaagggcaaagaaattttagaagatttcgataaaaaagtcagcgaattaagcgacaagctcggcgaccagaaaaagaaacgggtgtcggtaatcagatttatggccggccaatcaaggatttactataaagattctttcccgggaattatcctggatcagctcggattcaagtatccggaaaaacaggaaaaactgtttgagaaacaagacgacaaatttgtttttatgacggaaaataaagaatcgatccctgatatggacggagatgtcctgttctatttcacatataaacctgccgaaagcaaaaaagaagctgaaacatggcaaaacgattggacaagcgatccgctgtggaaaaaattgaacgctgtaaaaaccggaaacgcccatgaagtcgacgatgcgatctggacgacggccggcggcgtaaaagcagcgtatctgttccttgatgacatcgaaaaatactttttaaaatcttaagcaaaaaagggcatttccagtttggaaatgctcttttgtttattttccgttatagattctggacgtgccatcaggccatttcacccgcagctgaaaccggtcatattgttcgtcaagattgaaggcctcgagcacattgctgatcacgtcctgctctgaatcggatttggcgatcgaaagctcgcttaaaaccattttcatttcgtttaaagcttcctccccttcgcggtccgctccgttcagatagtctttaatcgatgcttcttcccgctcctgtttgtcgtatacggcttcaaacgtattgtgctttccatggccatagttcacttccaatgcaaatgtatcgtaaggcacgcttttcacatctgaaacaggggcgttatcgggaacggcctccttgccttccgcatgttcttccgctatggagccgcagccggtcatcaggatcaggacgagagcgataacggccatccgaaattgattcatcccgttcatctcctctatgcacattatccttagctatgtccactttgcggaaactcattcaatctaagcggaagcatttatgtcatcgctaaaaatgcttctgcatctcggacagccggctgaatggccgcttcccagaaatcccgcttcgtcagatcggcgccgagatgcttcatggccagttcttcaacagacattgaggctgtatcttttaagagagcaatatatttttcttcaaatgccgcaccctctttcagcgcttgcgcgtaaatgccaagcgaaaacaagtagccgaacgtataaggaaaattgtaaaacggaacagacgtaatataaaaatgaagctttgatgcccaaaaatacggatgatactcgccaagcgcaccgcaaaacgcttctttctgagcttcttccatcagttcgttcagccttccggcggatacgacgccgttttttcgttcatcgtagaagcgggtttcaaataggaaccttgcgtgaatgttcataaaaaaggcgacgctccgctgaaccttatcttccagaaggacgattttttcttcgtctgaaccggcttgttttaacgccgcatcggccacgatcatttctgcaaaggtggacgccgtttccgccacattcatcgcatacgccctgttcagcggcctgacgtccagcatggattcctgatgaaaggcatggccaagctcatgcgccaaggtggaaacgtttgactggcttcctgcaaatgtcataaatattcttgattccccgctgtcaggaaaattggcgcaaaagccgcccggacgttttcctcccctgtcttcagcttcaacccatctgtctctgagcgccttttcagcaaaggaggagagcttttttccaaacgttttaaactgcccggtaataaaagcggctgcctcttgatacgaatattcctttgctgctgaaccgatcggcgcttcgacgtcataccagctcagtttatccagtccgagcaaagacgccttccgggaaagatagtctgcaaacggctttttatgatcaataatgacctgccacatgacatcaagggtttcctgcttcatgcggttgatgtccagcggttctttcaatacattgtcccagcctctcgcctcatagacgttcagtctgaaaccggcgaggtgattcagcgtgctgctgagcaaatcagcgtgctgttcccagccgtggtccaaattttccgatacggagcggcggatctttctgtcaggtttagatgtcaggttctgcgcctgtccgacagacagaattttcgtctcgccatcttcttcatacggaatttgaatttggtcgacgatgctgtcgtacatatcgccccaggcatgatatccgtcaacagacaagccttgaatcaatgtttcctgttcggaactaagcttttccgttacccgctctcttctctcattcaaaatataagcgatatcggaaatgctttcatcttgaaggatcgcttcccattctacatttgggacaacggcaaatttgctgtcaagcacgaccagcgccttctgcgcatcggcagcgagccgggtgacctcaaaattaagggcattcgcctttaaatccgcggtgtcctgggcttggagacatccgacaaaagcgtctgcttcgcggattttaacatcaattgtttcaaaaagcgccagcgtttctttcaattcatcaaggccgctttttgagacggtaagagcctcggccgaacgtttaaaagttgaaagcagtgttttaatctcatttaaatattggcggaattcggcggagccgctcccgcctttaaagaaaacctcgagatcccacgtatccttaagttgatgaaatgtcattgttcccgtcccctttcattggcttgtttccattataagataaatttgccttttcagggcaaataaaaaaacggccggcttgtgagccggctcgcctcttcccttatcatattacagctgcctcatccgcttgaccgcatagctggccgtcaataaaccgattaggccgaacacaaataaaaacaatccgcctttactttgcggttgaccctgaatagcatctgtaccgtttgtcatttccgcgctgaatggttctgcgatttgcagggcttgaagcagcctgccatcctcccctttaatgttaaggattccgtccgtgtctacattttcactcagaacttcgcctttctttttcgtaacgtataaagggtccttcagttcatggctcgtcccgttctggtccgtaaacgcttctccctttttgagttcttgtgtctcgaaattgtgaaatccctcatccagaagagcttttgtatcgctgtacatcattttcttgctatctgccttcatgacgaccgcgattaaatcaaggctgccccgcgttgccgtcgtgacaagggtatgctttgattcatccacaaatcctgttttgccgccggttatacctctgtaaggaatctcacccgtcagcattcgatgatggtttttaagcgtcgtgtcccatgtctgtccgtgccaatccgtttgcttttccgaaaaaagcgctcggaacgttttgtttttcattgcgtactcagtaattctcgccatgtcggcagacgtcgtataatgatttttgtcaaacagcccgtgaggattcataaaatgagtgtcatgcactccggcatgttcggcaataaacgcgttcaaatcatccgcaaactgtttcacgcttccgctgagatgttcggcgatcgccgtaccggcgtcatttcccgaattcatcagcagcccttggagcagccgttttaatggaaccgactccccctcttccagatatacgcttgatccttccgtttgagcggcatttttgctgactttcacacgatcttccaaatttccgttttctattgcataaatcgccgtggcaattttggttatgctggctggatacatttttttgcggctgtttttttcatagaggacctggcccgatttcccatcgatcaatatagcggaaacgcttttgatttccggtttgtttttttctcctgcttgagccgagctatgaaaaaacagcgtcagacatagtacaataatgaacaggagggatcgtttaacattcatcgtgtcaccctgccttctttctcttttgcaatttttataaaaataggtcttttagcactttttaaattttaccaatgatgaactgtcgctgacaagccttttcttgtcaacaagccaaaattttgaatggaggaaactcattgaacaataaaatcgcaattgtaacgggcgcgacgagcggattgggtttattgaccgctttaaaactcgcaagcactcatttcgtaatcgcaacggcgcgccatccagaaaaagcggaagctctgcggaaccgtatagcggagctgtcgatcgagtcatcgattgccgtcgctgaacttgatgtcacaaacgaacaatcgatttcctcattttccgaagagctgaagcagtacggacagatagacgttctcatcaataatgcaggaacggcatacggcggattcgctgaagagctttctcttggcgactacagaaaacagtatgacaccaatgttttcggcctggtggcagtcacaaaagcggtccttccttatatgaagaaacacagcggcgccaaaatcatcaatctgagcagcatcagcgggcggatcgctttccccgctttctcggcatatgcttcatcaaagcatgcagttgaaggcttttcagaaagcctccgcctcgaactccgtccattcggcatcaatgtggccgtcgtccagccgggatcgtaccagacggcgatttgggagacatcgtttgccgcccaagtcactgtacctgatgccgaatcacagtacaaaacatatttcgagcggatatccgcctacattgcagcgagccgcaaacattacggaaacccggatgatgtggctgaattgatctgccgactcgctgcaaaaaagcggctgaacaggctgcgctatccgatcggcaggggcgtccgtctctcgatccttctccaccaaatcctgccatggcagatttgggaacgtgcggtcataaaaaaattgcttaaataatgttatttaaaataattataatttagtattgattttaattttatatttgttataatataattaacaaatgaaaaacacgaggaggaaatatcatatgatctctcaacaattaaaacagcaaaatcctgtacttgaaaactcaatgaatacgaatttgtcaaactggttcatcctttacacgaagcttcaccgttttcactggtatgtaaaagggccgcagttctttaccctacatgaaaaatttgaagagctatacaaccatgcgtcagaaacagcagatgtgatcgcggaacgcttgctggccatcggcggacagccgctcgccacaatgaaagaatacattgaccacggcacaattgaggaaaacggagccgaaaaaacggccgaagaaatggtttccgcactggtaagcgattaccgtcaaatccgcgatgaaattcagcataccatcgaacttgcggaagataaatcagatcattctaccgctgacctttatatcgccctgacagaggaaattgataagcagatttggatgctttcttcatttttggacaagtaatatgaaaaagccatggcgtttgccatggcttttatttatgatttgcttttcgcaagttttgctttcattgttgtttgctttccgtttctcagcacctcaaatgtgacagtatctcctgcttttgcttctgtataaagaatttttctgaggtctgaggtggtttcgacgtttttgccgttcattttggtgatgacgtcgccggctttcatacccgcgtctgccgcaggcgatttcggcgatactttatcgatgtacacgcctttattaagctggtctccgaaaaggccgagcgtattttgctggtactgttcaggcacctgctgcatatcgatcatttgcacgccgaggaaaggccgttccactttccctttttccaaaagctcgtcaacgatcggctgaacatcgttgctcggaatcgcgaagccaagcgattcaacaccgctttggctgatcttcaggctgttgatgccgatgacctgcccgctgctgttaatcagaggcccgccgctgtttccagggttgatcgccgcatctgtctgaaggacgttcatatcccaattcccttcagatgttgagacttcaatcgtccggttgacaccgctgatgatgccttctgtaaccgttcttgaaaattgaaggccgagagggttcccgatcgcaattactttttcgccggcgcgcagttttgcggagtctccgaaacttgcaaccttatcaacgcctttgctgctgatctctaaaacagccagatcagtcaaagcgtcgctgccgataatcttggcatccgcggtctttccgttgtataaggagatggtcaccttcgaggcgccttcaacgacatggttgtttgtgataatgtaggccttgccgccgtctttcttaaagatgacgcctgatcccgtgccgctctcctccacgtcgtcttcagagaagccgaagctcgtttgaatatttgaaactccgacgatcgcaggctccaaatcttccaccatatcaggtacgttatctgcgttcgtgacaggttttgtggtgaaattctgcgactgctttggctctgtctgtccggttccggcagtttcgctcggatgatcgcccggcagatacggggagattccaagcaccaagccgcctccgatgatcccgcccaaaatcgggctcagccacgaagccttgcgccgcttttcttttgccgctctcgtttccctggcatcttccagggctgcagcggtttctttattcgtaagatctgactgatcgtctgtatccttctttaaaatcagctcgggctcctttgccggctgttctgactgctgctcctcagaacctgccgtttgcggcgtctgcgcttcttcgtgaaactgctcttcatttgcatgtttttgttcgtcatcgcgtctaaaatccataagcgtacacttcctttatttttcttgtcttcaactatcgcaaatggcattaaagctttaacatccacaaaaaaagagacccggccatcgttcactctgttttcattccctttcttccctgatgaatatgttacgaaaacattgtgggataaaaatgaaaagaatatgtgaaattatgaaaattgaccagacttatgttaaaactagtataatgacgtagaaaggatgtgaaccgcccttgtcatactccatttatctagttgaagatgaagagaatttaaatgaattgctgacaaaatacttagagagtgaaggctggcacgtcacttcttttctaaacggtgaaagcgccaggcaaaaaataggccagtcacctcatttatggattctcgatatcatgttaccagatatcgacgggtatacgctaataaaagaaataaaaaatcaagatccggaagtccccgtcatttttatttctgcgcgcgatgccgacattgacagagtgctggggctcgaactgggcagcagcgactatatatctaagccgtttctccccagggagctgatcatccgcgtgcaaaagctgctcaagctgatttataaagaagaaccgcctgagaagaaaaaaggaacgccggtttcctgctatgaagtctatgaagacttgagagaagtctatgaaaatggcagcatgatcaatttgacgtcaaaggaatttgatcttctgcttctatttataaacaaccagggccgcgccttttcaagggaggatattctcaccagcgtctggggagtcgattacttcggaaccgaccgcgtcgtcgacgatcttgtcagaaggctgcgcaagaaaatgcccgaactgaaagtggaaaccatctacgggtttggctacaggatgttgaaatcatgaagaacaggtcgctcgcctttcaaatttggagtgtcatttgcggcatcctgttaacggtctcgattttgctgacgtttctattctcgacgacactgcagaactttttcactgatgaaatttatacaaacattgaaaatgagcagcatgttctgacggaatacggattttccgattcaccggaaagaggcttcggcggaagcagcggctcgcgaagcacaaaccgccacgttcagcacgtcctgctgcctgagaaaggaaccgtctatcagagcccgcagattctccccgattcatttatcgagaaggtgcagaagctcgggaaaaggcaggacgagtcatcgaaaaggtattcggagaatgtcaacggagagcacgttttctttgtgctcaaaaaaatccagacccaggaccagacgtttctgttgttatcctatgcgcttgattcatacagggacgatttgtctcatacgctgtttaagcagctgctgtttattttgatcgtcgtcattttgctgagctggattccttctatttggctggcgaaatatttatcaagaccgctcgtcacgcttgaaaagcacgtcaaacaaatctctaaacaggattgggatgatcccgtgattgtcgacagggaagacgaaatcggcaagctggggcacaccattgaagacatgcggcaaaagctcatccagaaagatgagacagaacgcacgctcctgcaaaacatctcccacgacctgaaaacgccggtcatggtcatccgcgggtatacccagtcgatcaaagacggcatctaccctaaaggagatttggaaaacacgattgaagtcattgaaggcgaagctgaaaaacttgaaaagaaaatcaaggatcttctttatctgacaaagcttgattatttgctgagacaagaaagacagtacggaacttttgatatacaagaggtcattaaagaagttgttgaacgcttgagatggtccaaaaaagaattgaactggaagattgatcttgaagaggaaacaatgttgacgggcgatcaagaacaatggagcaagctgttggaaaacgttcttgaaaaccagatccgctatgcggagacattcattgacatcagcgtcagttcgacgaaagaacatacgttgatcaccattaaaaatgacggaccgcacattgaagaagagatgctttccagcctgtatgagccttttaataaagggaagaaaggcgaattcggcattggactcagcatcgttaaacgaatcttaacgctccaccatgctgacatgaccattcggaatgatcaaaccggtgtgtgctactcaatatccgttccgagaaattagactgtagacgctgcagtcttttttcatataaacgaatagccgttgaaatcccggtagctcggcttcactgtgttttttggctttttcatccatttcttttcgcacaggacgtgctttggatatttaactttgtccaccttaattcccctgctgcgcaggcgcctgatcatgtcatcgatttctttcatcaaccttcaccctttctccgcaaattttgaccactcggtcaccttactttataatataaataatatcaaacaaaaaaacaagttacaatctagttaaaaatataacggagcaaaaaaagtgacccgccagtcaccccggtccgccgaaagccgcttttgggttcgatctttcaggaaggtgaaagctatgaaacaaaaagagaaagtcattattgaaacagccatcaaacttttcgctaaaaaaggatacagttctacttcagttcaagagattgcaaaagagtgccaaatgtcaaaaggcgctttctacatttattttaaatcaaaagaagcgctcctcctttcagtccttcactactactatgaaagaatctttacccgaatccagaaaatcaaaacggagcatgacaatccgcgcgatgtgtaccggatgcagctcgtcgtttttttcgaaaacattttggagcataaagagtttatcacgatgcagtttaatgagcggtcgatgccgatcaatgaagaaattgaggcgtttgcgaaaaaaatgcggagaaccacgctcaggctgcacatcgaaaacatccagaacatttacggcaaagacattgaaccgtacagcgccgaactgtgctttatgatcaacggaatgagcgatgtctaccttgagctgatgattttgctgcaccattcgttcgacctgcagtctctcgccgaccacatgctgaaccgcctcgacgatttggcgaaggggatgatcaagcgcaatgaccagccgctgatcccattcgaaaaagcagacgagtggttcggcccattttacacatttgatccgctgaaggacgccctgctcaatgaaatgcgcgtcaaagcgaacaagcagtacaacggcgctcctcctgcagaccttgccgaaagcctggatattctggagaaagagctgagaaaagaaaaacgcaaaaacgccattatcaaaggcatgatagccaacttgaaggaatatcccgcgattcgaaaagaaacggacaaactcgccgaattgctcaaaaaagacatgcaccatccgcacggatgatccgcaaaacaaaaccggctgcaatgcatgcagccggtttgttgattatgctttcggtttcaccatttcttcaggtttaacaacttcgtcgaactgctcctctgtcaaaaggttcagcttgagagccgcttctttcagcgtcagcccctctttatgagccagcttcgcgattttcgcagcattttcgtatccgatatgcgggtttagagccgtaaccagcatgagagagttggtcaggttcttctcaattgtttcccgattaggttcgattcctacagcacacttgtcatggaatgaattcatgccgtcggcaagaagctgaacggattggaggaagttgtaaataatcacaggtttaaagacgttcagttcaaagttcccctggctcgcggcaaagccgatcgttgcgtcattccccatgatctgggatgcgaccattgtcagcgcttcgctttgcgtagggtttacttttccaggcatgatcgagcttcccggctcattttccgggataagcagctcgccgattccgcagcgaggtccgctcgcaagccatctgacatcattggcgattttcatgagatctgccgcaagcgctttaagcgccccatgcacgtgtgtcagttcatcatggcttgtcagcgcatgaaacttattaggcgagcttttgaatgtctgcccggtcagagcgctgatctcttcggcaacggtgctgccgaattcagggtgggcattaatgcctgttccgacggcagttccgccgatggcaagatcgcggattttttcagcagcttcaagaatcatctctttagagcggtccagcatgtatacccagccgctgatttcctgtcccaatgtcagcggtgtcgcatcctgcaaatgagtgcggccgattttgacaatgtctttgaaagcttcagctttttcatgcagcgtgcttctcaagcggtcaatcgccggaatcagtttatcgtgaatcgcgaggacagctgccacgtgcatagctgtcgggaatgtgtcgttagagctttggctgcggttgacatcatcattcgggtggattttcaggcttgatcctttttcctgcaaataagccgttcccctgtttgccacaacttcattcatattcatgttgctctgtgttccgctgccggtctgccagacgaccagcggaaaatggctgtcatactttccttctaaaatatcatcgcatacggaaacaatcgcttcctttttttccgcctcaagatttccaagcttttcattggcaatcgcagcgcttcttttcaagattgcaaacgcatacacaatttcctgcggcattttctcggaaccgattttaaagttctccttgcttctttgggtttgggctccccaaaacttatccgcgggaaccttgacttcacccatcgtatctttttcaattctgtagtccactttcttatcccttccttctctaattctgcaatattctatatttcgataaaaatcgataaaacccttccatttaaattttatctttattttaattttagctcaatataaacccgggtatcttttgcatatttatatttcggatttgttttaccgtattctttcgatacatatgaaacctcataatgcttagaaaaagattgaataatgcgttcaatctcctccggtttccccgtaagcctgatttgcgccaactttctcactccgtctctgttcaatgaaaatttcgccaaacactactgtaacacagtatattgtttttttaacaggaaaagataacctatacaactccagaaacaccagggcaggtgacgatcatgactcaatcggaattcaaggaacacatccatgaaaatctcgcaatgctccttccccatctcgagcataacgatgatctgattcaaaataaaaaaatgctgaaaaacggaatcattttttactttttgtactttaaagatttgaatgatgacaagaaaatccagaaggctgcgaaattgcttgtctccgatgacagctcctattcattggaggatgtccggctccgcttaaacaagctgaatgcggaacccgttacagcaaaaaaggacgcgattaacgcaatcttcaaaggaaaatgtctgctgttgatcaacggtttgaatactgtatttgcactgccgacagctgagaaaaagaaaagaagccttggagaagtgaatacagaaaacgtcgtcagaggcccgaaagtcggttttatcgaggatgtcgatacaaatgtggctctagtcaggcagcgtgtcccggataaagaactgaccgtggaaaaaatcccgctcggcaagagcaagtttaaagacgcgaccattctctatatccagggcaaagcggacgattcgatcatcaaagatcttaaaaagcgcctgaaaaaagttcagctggatgatattcaagataccggcgttcttgaagaattaatcgaagataataagtactcgccgtttccgcagatccagaataccgaaagacctgacaaggtttcttcagcgctgtttaatggacggatcgcaatttttgttgattacacgccatttgccctgatcgtgccggcttctttcggaatggtgatgcagtccccggacgatttttacgaaagatggatcgccacgaccttgatcagatctcttcggttcagttcgattttcatcaccctgttcctatcggcgttttatatttcgcttgtatcttttcatcaaggcatgctgccgacggctctcgctgttacgattgcgagcacgcgcgaaaatgtgccgtttccgccgctccttgaagcgctgattatggaagtgacgatcgagctcttacgggaagcgggactgcggcttcccaatccgctaggccagacgatcggcctcgtgggaggcgtcgtcatcggccaggcggcggtcgaagcaaatatcgtcagctctgtgatggtgatcatcgtcagcattatcgcccttgcttcatttactgtgccgcagtacggcatgggcctgtcgtttcgcgtgcttcgttttatttccatggtggctgcagccgtgttcgggctttacgggatcatattgtgcatgctcgccatcttcacccatttggctaggcaaagaagcttcggcatcccgtattttaacccgaaccattttttcagcttaaaacatacggatgaagccattattcgtctgccaacaaaagctcgggaggtgaaccgtaaaaatggatccaaaaaatcagcacgatcggattagcacgtatgaagccgcttcgatcataaccagcacaatgctcggcgcaggcctgctgacgctgcccagggcgctgacgcaaaaaacgctgtcgccggacggatggatcgtattaatctttgaggggcttgtcttttttctcattatctacatcaatgcaaaaatcgttaaaaaacacaacgtcctgtctttttttgattacacaagagaaggctgcggctttataatcgggaatattctcaacctgttaatcgttttatacttcatgggcgtggccagctttgaagccagggcgatggctgaaatggcaaagtttttccttcttcagttcacgccgatgagcgtgacgattttcgcttttatcgtctgtgcaatttatttggttgtcgggggtatcagcgatatgtcaaagatattcccgttcttcctgtccgttaccattgtcattcttctgatcgtctgcggactgagcctgaatatgtttcagctgaaccatttgcggccggttctcggccttggtttggagccggtcagcagagctttgacggtcgtttccatttcatttttaggggtggagctgatgatgtttctgccgaaatacgtcaaaaacaaagaaaagctttttaaggcatcggcgattggatttgggataccgctcttcttatatatcctcacctttgcggtcgttgtcggggcgctgaccgcgactgaggtcatgacgttgacatggccgacgatctcgttgtttcagtcttttgagataagagggattttcatcgaaaggttcgaatcgtttttgctcgtcatttggacgatccagtttttcacaacgtttgtcgtctatacgtactttgccgcttcaggacttgaaaacgtattcggatggcctgtgaaaaaaaacgtcctcttcatcggcgtaatcatctatctggcatctcttgtacctcaggacgccaatcaagtagtcgccttcagcgattaccttggatatatctttatcgttgtcttctgtgcacttccgcttatgatctttttgctcgtgtccatcaaaaggaggtttacttcttcatgaaaaaaaagggaatgttagcagccctttctctgcttctccttttaacaggctgctgggacagcaggcagatcgaaaagcttagcatcgccatcggccttgccctcgataaaggcgaggacgataaaaacgtgaaattgacgtatcagtttcttgttcctaaaaagatcggacaagacggcagcgctcaggatccgtctaaagtggtgtccacctccggaaacacggtccatcaaaccatccgttccaccgctttgaaaaatttcccggtattctcgcagcatctgcaagtcctgattttctcagaggagcttgtatccgatatttctctggaagcattgatcaatcaatttattagggacaacagcatcagaaggagcagcgaggtctatatgacgcccggagctgccggcagcatactgaaggttgatggtgcaagtgaccctgcgtccgacgtgatccacagcatctctgaaaacagagcttcgacgatcaagctgctcaagcccgtcacattgaacgatatttcgattaaaatgcagtctgatttatcttatatcatgccgaaggttgtgatcgaaaaaggacagcttcagcttgaaggcggcgccgtgatcaaaaacaacaaataccatgcaaacctttcgccgtctcagatcgaagcgctgaatttattaactggcaatgtcatcggcggagtgatcgactcaaggcatgatggacatttgttctcgtatgaagtgttttcgatgacccaccgcgtgcgggcgatgaggcagaacggaaagtacaaattcgtcgtaaatgccaatattaaaggaaggctgtcagaggactggtatcttggagaggattcttttaatgaccaatatataaaaaacatagagaaatcggttcaaaaagacatcaaaaagcgggttgagcagctgatccatgtcctgcagcacgatatcaaaacggacgtcaccgatttttccgacaatgcgcggatcaattttccgaaggagtgggaaaaagacagattcaattgggacaaacacttcagcgaagcctatatcgactatcatattaaagcgacgattcaggactttggaacaaaaggtgcgacaaaaagcagatagcgccccgtttttctgatagaatgtgtttgaaagggtgatgagcttgaagcggatattgcacatgacaggcatttttttgattgcagcggcagtcattctgtccggattcattatcagtgatgtcgcctatgatccgtttatggaggattcgcagtcgatgcttttcttcacgatcggcacatacctcaccactccgtttttttgcttcatcggcggattcattttgctaggcatcggcaagttgatcgacttgccggagaaacacaatgccatagtggccgagcggctcgacatcatttgccaaaacggtacagcgggcgaacatgcacgcgaagaaaacgaggccgcccaacttaccgcccgcacggttgaaacagattcattcactcttcctgcagccgaggatcgaaaatattggaacggctgaaaaacggctttcttgagaaagctgttttttgtttgatcagtcgacaagtttgtttcggtgggcgtagattgcggcttgtgtccggtcgtcgacttcaagcttggaaaggatgttcgtcacatgcgttttaactgttttaatggtgatatataattcttcggcaatacctttgtttgtcttgccctctgctacaagtttgaggatttccaattctcttgccgtcagcgattgatgaaggggctgttcgccggctgaatgtctcagcttggacaacacttttcctgcgactttggcttcaagctttggttctccgacgctcgcagccctgatcgcatcggcgatttcactcgctttcgacgttttcagcaaatagctgagcgctccggcttcgatgaccggatagaccttgtcatcatcaacgaagctcgtcagaacgatgattttcggatcggcaagctgccggcatatttgtttcgtggcctcaattccgtccatcccttccatcacaagatccatcaaaatcacgtcgggtttggtttcaagcgccaattcaacgccgcgctttccgtctgatgcctccccaatcacttcaatatcaggctgggattccaggaaagcggccagccccattctcaccatttcatgatcatcaattaacaatactcgaatcaccttttaagcctctcctttttgttgttcaaaaatcggaacctttacatcaacctgtgttccttttcccgtaaatgaaatgatttctgccactccgccgacttcgctggctctttccttgatcgagttcagcccgtacgaagatgttttgacggcatccatcttaaatccttcgccattgtcaatgactttcaactggagctgtttgttcctgagcagcagtctgacggtgacttttgtcgcttttgaatgccggaacacgtttgagagcgcttcttgaacgatcctgaacaggtggtcttccacacctttcggaagtttgcccgcatcctcaatctcccaatcgatgtcgatcgactgtttcgctttaaattctttcaaaaggtctgcaagcccttcttgtagacctttcccttcaagcgtaacaggtcgcaaatgcaaaaggagcgccctcatttcattctgggcatcggccgccattttttcgaccattttcagcctttgagcgagcttttcatcagccgcagcatcgattccctccaaaacagctgaagtcatcatggaaatcgcaaacagctgctggctcaccgcatcatgcaattcgcgcgcgagacgctgccgctcttcggagatcaccgattttttcatttgatcctgccattccgctctctcattggacagcttttgcaaagaggcaacctgtctttcgatccgttcggccatctcattgagctggtcggcggccagcccgatctcatcgtctccaagcgatggaatccggtaggcaaagttgccgttttcgtactttagaatagactcgatcagcttttcaagccgttttttcagctgattgccgaacatatagcctgagccgaacccgacagctgtgctgatcaatgcgagaagcgcgataaacggaatcccgaaccacctggaaacgatgagcaccctcggatccagctggtaataaaacagcataaagcccaatacagcaagaaaaatcgtaaagctgacaccaagggataagcggacggcgcgccattgaatgtttgcaagtctgttcgttctcatatgaaccgcacatccacatcgccgataaacagcgaaatcgaaattttgacccgtcgtgccgactgctcgtaattctctgtctcggaatagatttgattgccgatgccgctttttcggccgccgatgacgtcaatgtctccaacgaatgcagaagagctgatggacacctcaagatcggacggaatgtaaatatcgacatctccgatcaaccccgtaatgacgatggtgttttctccctctgaaataatcgcctttgacaaatcgattttcacgtcaccgataaacccggagatattcaagtcatttaagtcaaaaggtgttttcatcaattttacatcaccgaaaaagaagctgcgctggccagggctgttcttctcctgaagcggcttgaaatccgccttttcctttcccctgtctttcggcttatggcggtcaaataccggctgatttgtcaccagccggtaccccgcataaattaagaaagcggcaaagaaaaagccgaacaggctgaatgtaatgctgaagatgtctttcagcagcagaaagcctgcaaaaatatacatgacagacccgagccagcggcgggaatatttgtggagaaaatacccggcaaaaagaaaagcgagcggccagaataacgcgtctccaagcccgctgttttgcaaaaatatgctgattccgaagagtacgatgatcagtccgatcagctggttttttgtaagacgcatgctgactcgagccccctttcttcttgtcgattactcaattgagacattcccgctcgtaattgagatgtcgattttattttttccatttcctttttttccagtcagcgtccgcttctcattggcgacttggtcaaatgaataggaatgactgatgtttccgcttgtcgactcggcttcaagactgatgtcggcatcatcgggcaggctgagcttggtgtttccggatgtctgtttgatgctcagagaatcgttgatctctgtaaaggaagcgcgcaaattgcccgaagtctgtttgatgctgagtttgccggtgacattttcaagttttgtattaccggatgtggagcggatatcagcagctgccgtttgaacgttttccagcctgaccgatcctgacgtcccttttacagaaaggtcttccgcctgaaggtcatcggccttgaggctgccgcttcccgactttaaggctacatttcgcaaatgcagaccgccgccggacagtttgacatttccgcttccagaagaaatcgacagatcatctttatattcagaagggatcttgacaatcagctcatttttcttccagaaaaacggccaaaagcctttcgaatgagcggaaagctgaagagtacgcccctgttcggacgaatcaagccggacgttttttcctgaaatctcggcttttatatcatcgcggttttcagcttgaatgttgactgttatactctttgcatcaatgtcaattttatcgatgtcttccgcctgtgcatgatatgtgcgggctgactcttcatcgaagccgaagaaagaaaagccttcacgcccattaaacatcatgcctgcaaggatgagaatgccggcgatgatcagcagttttccaaccgtttttttcatttagaaaaccctttcggctagtaagtgtatgctccttattataaggaaaatggtctttgaaagaaatcaaaaattgcataaggggctgtgagagcccctattcgtttatgcatttcccgcaggtgtctgcttttccaagcctgtctttttagccctcattttttccagctcttcttccacttcttttgcatattcaaggcggccgaatgggctgcttgatgaagctgataattcagcatagctgttcacccttgtttccatctcttcaatccggttttccattctcataaattcccggtaggcgctttcgctgtcgattttattaaatgatgcattcatatgttctttcgctttcaccgcgtttgccctggcgatcagcgcatgctttcggtctttgatatcgcgcagtttaacctcaagtgtctccagctgttcctttaattcagcaagctgctttttcgcgtgctggtgagcgtccttgtattcagcagctttttcttcaaaatacttcatttctgagagcgcctttttagcaagttcttcttcacccgcatcaaaagcgagctgagcctggtttcttcgcttgacagcaagcttttcggcttcttccacttttcctttaaaactatgttcaattgtctgctgcttgacgatggtatgcttcgccttggcgatatcgctttccatgtcgcgtacgtattgattcagcatcacccgtgggttctccagtttatccaatccttcatttactgatgcgacaaacatgtctctgattctttttaaagccatgatctcgtcctcctaaaatattatttattctttttcaaaaagtcttcccactctgcatcaaagcctgtgtcatatgaagctgcggaaggctccgttttctctgaataaaggatgtcatcctgtttgtcatcttgcttcatcattttccatccgaaataaaccatcgctgcagcaaccgcgatgccgatcagaaacggcaatgaccctcccaaaaacatgatgccgaagatcgcggccagtaccgcggcaaactggcgtccttccttccattttttcacggaatagaatagaagcaatgctccaatagcacctgtaaccaatccgccgaaatggcctccgccgaagaacagggagacgccaaaaaggattagaaaaaagccgatgatggacttcccatttatattcatatttgctcctcctttctcgttcatgtctttactatagtcaatttcaggcttcgacaaaacgagtcacagattgattttgccgtacgaccagggtcgtatggcacatcggacccgctcgcataaaaagaccgctcatctcagcgagagagcggtctttctgcaggttgccttgctatgattcaactttaggattccagccgtccaatacgttttcaattgtccatttctcagcctcatgatcggcaagctgccttcgggcctcatgcgaaatcgcacccggacccgtattcccgtattcgtacaatctggcatcggccgcagaaaagcccgacatatccgtccatccttcaggcttgatgtgtgcgcctaaatcgcagcggtgatatagcacactggcgatggcgtcggggtctcctcccggatgccatgggcgcccgaggtataccgttccatctgcggcatcgcttgtcactctgcagtttgttatcaataaaccgaacggctttgcgatatgcgtgctcgcagctgtcacataaccgttgtttgtagcggacccgcggtcagcgctatggatctggcactcttcaaacacagctcttgctcctccgaaaatgaaatcgacatcgccttctatatagcattgataaaaatattgtgtaccgtcattgacaaacagtgtatcttgtctgcctataaacctgacatatttgaacgtcatcctgtttcctttcgcataaaccgccaccgcttgcgtatcggtcgtgtcgactttcgtgcggtcgaacgagttttcaaacgtcaaattttcggcttcaacatgatccgcataaataaacacgcttgaacttccggtcgtgccgtatttccctcctccttccttttcttttccggcatagttgtcatacgtaatcacagtctcgtaacgattttcgccgatcagcttcacaaacggctttgtagccggaatatgaacgacttctttgtaaactccttttttaatgaatatcactttctgttcccgactgtactcaggcaaagcatcgatcgcctcttgaacggtttgaaattcgccgtctccatccttcgaaaccgtcagccgtatagcagctgcctcccgattaaccacttgaacactccctctctttgaaaacgcttacttaaagtttacgacaaaaagccgttttcccctgccggaaaacggcttgatttgatcaatcggcccgtttctgttagataacgattggcggatggctcattcatgattttttctttgtccggaatacatcagcgcttcgttcatattcgacatccacttccccgagacggtgattgacaatgcgcgccgccgcaaataaataatcggacagccggttgacgtatggcagcgcaagcggcggaatgtcttcttctttggccaaagcgacaatctttcgttcagctcttctgatgaccgttctcgccgcatgcaaaaatgatgccgcttctgttccgcccggaagaataaacttggtcagctgcggcgcttcctcgacataggcatcaattcgttcttcaagcatggtgattgattcagccttgagcttgccttcttcctgaacattgacatgcgccaaatcactgccgcagtcgaacagctcatgctggatggcggtcaactctgacaaaatatcatgaaagagcgcctcttctgcttttaaataagactgagccagcccgatgaaactgtttgcttcatccagtgtgccgtacgcttccactctaagatgatctttatcggcccttccgccaattaaactcgtttttccccgatcgcctgtttttgtatagagtttcatttcatactcctctctttaccacttgtctctatagtataccctgtttataacggctgcatagatcgtttcattatgaaacacaaatttccggaacaatcattgaaacaaagtatcgttgaataaagaaacactcgcttttataatagaattgtaaacggttttattcaaagacaggtgggatgaggatggaatttaatcagcaaacggccattatcacaggtgcaagccgcggcatcggcagagccattgcggagttgcttgcggataaaggggcaaatgtcgttatcaatgggacaaacgaagaattgctcaagtccctgtgtacacaattgaatactgagagaaagtgcgcttcttatgttgccggtgatgcaagtttgccagaaacagcctcgcttctcatcgctgaggcaaaacagcggtttgggcggatcgatattttggtcaacaatgccggcgttaatttgcgcaaaacgaccgttgatacgtcgcttgaagaatggaaaagagtgatagatttgaatttaaccggcacctttctcatgtgtcaggctgtcatcccggaaatgatcacgcagggcggcggaaaaatcgtgaacatgagctctacgacgagcaaaacaccgcatcacaatgcctctcctgcttacggtgcatcgaaagcaggcatcaactatttaacgatgcatttggcaaaggagcttgctgaacaccgcattcatgtcaacggcgtctgcccgggaccgattgaaacggatatgagcaagcagtggagcgaggagtaccgcgcagcagtcgtcgaacggattccgctgaaaatgctcggctcaccagagcatgtcgcaaacgttgtcgcctttcttgcctctgacaaatctgactttatgacaggcgaaaccattaatattaacggcggcacctatatgaactaaaaagaagagcctccttaatcggaaggctcttctttttttatgcatgccgctcacgcgtaccggacagcatgatcgcctgtctcaccgcttcttctatactcgcaggatcggctttgccggttcccgcaatatcaaaggctgttccgtggtcaacactcgtacggataatcggcaggccgactgcaatgttcacaccggcttcaaggccaagcaccttaatcgggccgtgtccttggtcatgatacatagccaccactatatcaaagtcgcctctcactgctctgaagaaaagcgtgtcagcgggcagcggaccgaatgcctgtataccttcactttgtgcgcgttcaacggcaaggacaattttctcttcctcttctccatgtccatctcaccggcgtgagggttcatgcacacggcgattttaggctgcggaatgccttcgcgaatgagcgtgtcatgcgccaattgaattgtcgttacacccgtttcgcattacgagagagtccgttcaaacgattgggacagcccctccaacttaaatcataaatgatgcaatatagggataccattcatttcatcaagtgccgcgcgcgctcgttcaaacggctttattcttgaccggcagcggcccacgtttccggaacacgtacatagtcaatcactgccaaaataaacgttatgatcgaaccgcttaagacatccacccaaactccccctttgtttgtgagcctcttacaggctcatggtgaaaaacatgtacagatccgggcagcctacatatccagcaatttcaaatagacagcttcaatctccgcaacagacatcggctttggattgttatccatgagccttttgacgtcggcagccgcctcagcaagcgatggcacatcctcttttgataccccgaatgtctttaaattttgcggaatatttaaatcggcggtccactattcaatttttcgtataacccgctctgcttggctggacttcgaaccttttggctcgattccaattacgccggccacgtccgaaaggcggtcagttacatgatccgcgttgaaggccgttacatgcggaagcagcattgaattggccacaccgtgcgaaatcttgtattttccccctagagggtaagccatcgcatgaaccgccgctgttcctgcgcttgtcaaggccattccgccatacatggcgccaatgagcattttttctctcgcctccaggttatctccatgatggtaggcctgctgaatgctggaggaaatcagtctcatagattcaagcgcaaacatgtcgctgaatggatttgctttgttggaaatataggattcgagtgcgtgtgtaaatgcatccattccggttgcagctgtgattgcctttggaagtccggtcgtcaaaactggatctaaaatcacaagcgacggcagcagatagggactgactataccaatctttaattctttctcagggaacgttacaatcgcattcggcgtcacttctgaccctgttccggatgttgtcggaatcagcacaagcggaacgccgggcttttcaacgagattcgtgccaatcaaagcagaaatcggtttttcatttgttttcagaacagagaggattttagccgcatcaagcacactgcctccgccaattcccaaaatcgcgtcatggcctccttcagaaaaaagctgaaaaacctgttcgatattttgctccgtcggctcaggctgtatatccgtgttgacttcacttgagatgcctttctttgcaagcccttctttaatttggtctgcatagccgagagagacgatcgacggctgagttaaaataaacaccgaacgaatctgattcaatccaatttgatctaagtaatcgccgagcaaattgagtgaatgtggaccagcctcaattcgggcggccgttcgaaaatgataaagcgttttcataatcttactgctcctttgccagttttgcttcaattccgtagccttccagcatctttttcacttttagcagcggctctcccgacagttctgcaatcggacgtttaggcggtccgacgtcgatgccggcaagctccgctgctttttttagcggcgccggcagtgaaccgagtgaaaacgtatcacggagcggctgcagctgctgttgatagtgctcgctctcttcaatgtttccttgtttaaaagattcatagattgaaacaacggtgtgcggaaacacattggctgtggcagccacagctcctgtccctcccgccttcaatgtgtctaagatcagcgaatcagttcctgccagaacggaaaaggactgttcttttgtacgctcaagatacgccttaatattggcgaagctgccgctgctgtccttaatgccgatgatgttcgtcaatgccgccagcctttcaactgtttcgggctccaatgatacgcctgttctcgacggaatgttgtagagcaggacaggaagcgcgacattttcggaaatcgtgcggaaatgctgatacaattcctcctgcgaaggtgcaacaaagtatggcgtaataatcgaaagaacatccgctccaagatccgccatttgattggataaagaaatggtcgcctcagtactgttttcacctgctccgatgaaaacaggcactcgtttattaaccgcttttacaactgtttcggcaatttgaagcttttcctcttgcgagaataaatgaaattcgccatttgtccctaaagcaaaaatgccatggacgcctgaatcaattagacgattcaccagcttttcggctgcgcccggatgaaaggcctgttcttttgtaagcggtgtcagtatggcagggataattccctctactttcaagtgacttcgctcccttctgttgcatttttaaacaatcaaatagtaaaacgctttctcaaatttcattataaaggtgttttgattaattaagcaacattttttaggttcggaacaaaagagtaaaatctcaccttcagctgatgcgttttaaaacaagaaaaaaacctgtcaaaagacaggtcaatttaatcttttaaagctttcacacaagcggctgttttattttgaatttgtgtcaaaaaagcggtttgatccgctgaccggccggattgagtggccgctacaaggacatcactacacggaacatgatgctgggctgcggcaaatgccgcagcgcttatcgccttcacaaattgaccatcctgcaaacagccgtcaactaacacccacatgatcaaacgccccatcgtgtctttcataccgacgatgcaaagatcaccgctttccgacacaatatggcagtcagccaattcagcatcatgttggataaacagcgtttcctgttcaaaagctgacgagccatgcggccatccagagttatttccgctgtcgaaaataagttttcgtctccaagcaaagcccctttctgaggacagaagccgcagcgggcggtctgccaaaaatgcgatgccgtgcggcaaatattgttcaattcgctcttttaaaaagaggggctcggttttccgcgggatgtttttcgccataattgtaaactgcggatttgaacgctggggatggtccagtccagtgatgtccgtatcatacactcgtccgatgcgcccagcagaaagagctgcttccgggcggtcaagaacttctgcttttccatcttttaatagcagcagacggtcacagtataaactcgcaatattcacatcatgaaacaccccgaccactgcgagtttggatgcagccgtttcttgtttcattaaatcaagcagactcttttgaaatgacaaatcgagaaaactcgtcggttcatcaagcagcaaatattcgggttcctgggcaagtgcctgcgctaaatacacccgctgctgctctccgccgctcagctcatggatggatttttgggcgaagcgaagcgtgtctgtctgcttcatcaccctcttcacgatatcatggtcttccgccgtcagctgccgaaaaaggcctgcttgatacgcgtagcggccaaactgtaccgtttcctccaccgtaaaggaaaaggcctgctccgttttttgaggaaggaccgccattttgcgagcgagctccttcgttttgtactccccgactgaacggcattcaagcagcacctcgccgcttcggggggcaattgttcccgacaacattttcagcaaagtggtttttccgctgccgttcggaccaagaattcctaaaaattcacccggctttacagcaaaactgatatcctgtaagacatccgtttttccatatccgccggacacccggatgacatcaatcatgaactcgccctccccggtagcgccgaattaatataaagccgaaaacaggtgcccctatcaatgcggtaataatgccgatcggcagctcggacggctcgataatggttctcgacaaaagatctgacagcacgaggaacgaagcgccgttcagcatcgagagcggcagaagatgacggtgatccgtaatcgacagaagccggataaaatgcggaatgacgaggccgacaaaaccaatggttccagacacagcaaccgcactgccggttaaaatagctcccgccaacagaacgatatatttactccgcttcacattcacgccgagcagcctcgctttttcctcgccataagtcatcacattcagttccctcccgctgatcaaaagcgcggcagcgcccgcagcaaaaaagggcagaaacaacgcgacatagccccagcccctcatcgatacgctcccgagcagccagtgtacgatcggttttaaatcatcgccggtcaaagcgatcatgagagaaataagcgcacccaaaaacgaactgaagatgatccctgttaaaatcaaagcggacagggtcaacaaagggtgtacgagccgcgcaaaaaacaaaaccaaaaaaatcacgataacagccgcagcaacgcttaaaaacggcagtgtaaaacttccgatcaccggcagctgaatcccaaaaaacagcgtgaccacggcaccgacggccgcgccagacgaaatgccaagcgtatatggatccgcgagcgggtttttcaagagcccctgaaacccggctcccgcggcagccagacccgcgccgacaagagcggccaaaaccaccctcgggagcctgattttcatgatgatgttcgcctctgtcggatcgggatttaacccttgaatgccaaaccattcttccaaaaaaaccttcataatagaaggaatgggaatctccaaagatccgatagagattcccataagaacggatgccgacaaaaacagcaggctgaaggcatatgccgcaaaacggttatttcttaaaaacgtcagggtaaatatgttcagcaagctcttcgacccctttgatcaatcgcggccccggacgggtcacgaggtcagggtccacgtcgtatacttcattatttttgacggctttgacaccgctccagccgctccgttttttaatttcgctgacagcggattcgccgtttgtcgtcacgatcgcatcgggattcagcttgacgatcgcttcttccgttatcttggcccagcctttctgcgcggaagcagcattttccgcatggatcgcttcaagcatttcattcataaaggtgccttttccggtcgtataaatgtccggagccggagacacttcgacaaatactttcttttgatctgctttagatatggctgccgctttttcttttatgccagccaggtcagatttcatgctcttgaccaggctcgctgcttgatcctctgcgcctgcagcctttccgatcatttcgatcgaccggtacgtctcttcaaaagaggccgcatcatttacagtcaccaccgtaattcctgcatctttcagctgcttcagcccttcttcggcactctgcatgctggaagcgtgggccaggaccaagtcggggtttaacgaaatgattttttccgtattaaattccatgcccccgattttttcaacgtttttcacttcttttggatatgtatcaaaatccgtcacgccgacgacttttttccccaggccgagggcgtatgtaatttcggtattgctcggcatcagagagacgattttcttcggttctttttcaattttgacctcttgtcctgaggcatcttttatggtgaccggaaacgcttcagccgccttctcctgtttttgctcgtctgccggtttttgcgcttggccgcagccgctaaggacgccggcagccaacagcagcgacagcaataaaagcccaaacttcttcatcctgcttcctcctcgggataaaataaaaacatctctactcagtaaagatgcagcaaaccaagaacgtacaaataagtgcacatcacttatacgcatctgtcctcgcagattacgcggtcatcatccaggcggttattccggctattggttcatcgctcccggcctgtccgaactactaagcggagctctcgccggcttcccctcttaagctgccgatcagcagcgcctttctgactcattcgtatcctaatttcggaattattatactataatcgacacaggtctgtatatgagattctgaaaaggagattttcagctgaaaaacgttgtttttgctaaaacaattacgatatattgcatatagagaaagggtgattttatgccgataccgaaaaactatacgcctcaggtcagactttcagcaaaggaaaaagcgtttcaccaattgcagcgctggattgtagacggaacccttgaacccggcgaaaaagtcacggatgtcgatctggccgaagcgctcggcgtcagccgcacaccggtcagagaagcgcttcagctccttgaatcccaagggtttgtggaaatgaagccgggaaaagaaacaaagatcacgctcattcatcccgatgatgcgctggccgtctatcctccgctcgcacatctccaggctttggcggcagaactggctgcgccgcttttaacggaagaagagatcgccgagctcaaaaaactcgctgctcaatacgaaaccgcgtttaaagaggaaaggaaccacgatgcagctgaactggacgaacagttccaccatttgattacagaagcggctaaaaacccgtatgttcttcagttttctgccgttctgcagcttcatgtcagacggatgaagtatgtgtttttcaatcggcctgctgctccgaaaatgcagtccgccgccgagcattgggaaatcatcgccgcttttgaaaaaaacgatccgaaattggcggctgaagtgatgaaaaggaattggctccgtccgatggaagatattcataaagttttaaaaggcagggaacaataaagcgccaagcacgattttcgaccgcggtatccagctgcgatatactgtttattagatgttttctttcatcttaactctgtaacaaggattgatggcatatggatttaaagctgaaaaacaaactcgtgctcgtaacgggttctactgctggtattggaaaagcaacggcggaagcctttttggcggaaggcgccgaggtcatcgtaaacggacggacagaagaaaaggtccagtcggtcgttgatgagctttcccggcacggaaatgttcacggaattgccactgatttatccgatcctgaagaaagcagggcactggtcgaaaaaaccgctgaaatcggggagcttgatgtcctcgtcaataatatgggcttctttgaagtgaaggattttacagacgtgacagacgaagagtggctcaaatattttgaagtaaatgttttaagcgccgttaggctttgccgcgcgtttttgccggccatgctgaagcggaataagggaagggttctcaatttggcaagcgaggccggcattaaaccgcttccgcagatgatcccttattccatgacaaaaaccgctttgatcagtttgtcaagaggtttggccgaaatgacaaaagggacaaatgtgaccgtcaactctgttcttccgggacctacctggacggaaggcgtcgccaattatatggaaggtgccgccgctcaggagaaaaccgatttagacacctttgtcaaagattatttcaaagtgaatgagccgacttctttgattcagcgctatgcaaaaccggaagaagtggcgagtacgatcgtctacctcgcttccgaaaaagctgcggctatcaacggttcagctcaaagagtggagggcggaatcatccgctcgatttaaccgaaatcctctgccggtcggcagaggattttttccttttggttaagaaccctgcttcagacctcccgtcagcctttcgcggtcatccggctcaaagccgttcagccgttttaaacatgatgcacgccaatttgccgacagttcctccacctcgagaagttttttgatgccctcaatatcgttcttttcatgatgcttgatgcgatttgcgtatgaaatcgtaatgcctttagggtggcgtgagattcgtttcagaccatgctccttacagacgaacccttctttcagcacgcgaaagtaaaaacccgtaaatccggtatcttgtaccttcagtatcatgtccggcataccgtaccttacggttagtttatagcagggctgcctcggctggctcacctgtacaacagctgcacccagctgaaagatgtcgccgatatgaacgtcatcctccagcagacccttgatcgttaaattttcgccaaatgctccgtattccagctttctttgcagttccttttcccaaaagagataatgttcatacggatagacgcacactgctttttccgcgccgccgtgatgaatgagatccccctgtccgtcccccgtgaaattagtagatgacaggaagatggggccgcttgccggcttcttgtatattccggtagacacagctttattttgaaactgaatttcctctggcttccctacattgatcgaaaggatatcggcatattccattcatatcacctcttacattcaaatgtcctgcaaaccccttttgagatttaagtataatcgacctcttaccataaaactattcaatcgttattataaaaacaataggttaaacctatcattggaattcggctgtttttcagatggagaggaggaaagagcattggagctaaagcaattggaatactttatggcattgtgccgggagcttcattttacccgcgccgccgaaaaactgaatatcgctcagccctcgctgagccagcaaatccgtttgcttgaacacgaaatcggaatgcctttgtttaaccgttcaggcaaacgcaccgtgatgacggaagcgggaaatattctgctccagcactgttacaatatctttcatgaactgtcacaggcgcgagacgcgatcagcgagcttcaaggtttaaaacggggaacgcttaaaatcggggcgcttttgaccgtggttaattatttgcttccccggaccgtggtcgaatttcaccgcagctaccccaatattgaattgtctgttttagggctgagaaccggggatatttacgaccggctgctgcaaaatgagctcgacttgggcattgtagcccagcgggtggaacatcgtgacttagaagccgtcccattccttacccagcatctcgccctcgcggcgcctgttgacaatccggttgcaaagcggcagtttgtcacgcttgacgtgttaagggagattccatccattttgctgcctgagacgtattttttgcggcagctgatcaacgaaaagtgccgcacgcttggattcgagccccggccggtcatggaaatgacaacgatggaatcgatcatgaacatggtcggtaaaggcatcggcgccaccattttgccgaaaggctatcttaatgctattggaaataaatccattcagacgattccgatacaaaagccggatttgacgacggagatcagcatcgtttaccgtaaaaacaagcatatgtgcgctgcaagccgggtgtttatgaaactgctgatttcctcggtcaaaagcgaaaccgctgatgcgccgccgcgttaaaagaaaaatcctctgcatgtctgcagaggatttatgtttaggctttgtgtgagtcatagcgttttccgttaatatacagattcgaaaaaacggggtctttcacatgtttcagttccatcggaacatcgacgccgtcgatctcggaatcagccactttcagcccggtgaccggagagtggtcgtatgccagcaccctgatcccgtattgtccgcccatgcttttcagctgcttaacatcaaccgtgcggacgacaggtttgaaatctccggcatctccttcttcatattccatatcgatggcgatcacttcgcgcttcaagcttttgaccgtatttttgtgaaagtagatgttttcaagaacgccgccacgcaccgaattcgttttaatgcggagggctctgtccaagttcgggctgtccataagattgccctctgcgatgacgttcttcacgccgccggaaatttcgcttccgatcgtgacccctccatgcccgtctttcatttcgttatgttcaatgacgatgttttccgacggaatgttgatccttcggccgtccgcatttcttcccgatttgacggcgatgcagtcgtctccattatcaaaatggcagcccttgatcaccacgtttttacacgattccgggttgactccgtcggtattggggccgtgtccgatgactttgatgccgtccactgtcacattctcgcaaagcacgggatgaacttgccacatcggcgaattcagcacagtgacgccttgaatcaatatatgtttgcagcgatacggctgaatgaaattcggccgcaaataatgcccttttccaaactgccgctcagtgaccgggataccgcgctcagccatttcaaacaaagcgttccgatctttttcctgtgaaggctggccgttcgttcctcttttccacggccaccaatgctcgtcatctccttgaccgtcaagcgtgccctttccggttatcgcaatattatcggcttcgtaagcgtagatgagcggtgaataattatagagctcgactccttcaaacctcgtcagcacaacagggagataatcttcagggttctgactgaatttgatcaccgctccctttgcaatatgaagatccacattgcttttcaatctgagcgcaccggaaagaaacacgccttcaggaaccgttactcttccgccgccggcttggtgggcttgatcaatcgccttctgtatcgcttcggtcgaatcgttttttccgttttcgtcagccccaaacgatgtgacatcaaatgagcgattcggaaataccggaaccttcagcttctttacaatctcttcttttattttctgcagactcacgttaccgccccctttataatgtgacgcctgttttaaatatcgcaagctccctgaaatcgtttatctcattgttcagctgcctgccgcttgcgacttcgatcaaatacgctgtcagctccttcaaaacgtcatcttctgatcggtcttcgagcacctttcccgcattaaaatcgatccaatggcgctttgcctcataaatcgccgtatttgtcgaaattttcatcgtcggcacaaaggtgccaaaaggagttccccgtcctgtcgtaaataaaacgatttgacaccctgcagcggccagtgcggatgaagcaacaaggtcatttcccggagcactcagcaggttcagccctttctttttcaaaacgtccccgtattcaaggacatccgccacctttgaagtgccggctttttgcgtacagccgagcgatttatcttccaatgtcgtaatgccgcccgctttgtttcccggagacgggttttcatagacgggctgcctgtgatcgataaagtactgtttaaaatcgttgattaagcggacaattttatgaaacacttcctcattttcagcccgctccatcaatagcgtttctgccccaaacatttcaggcacttctgtcaacaccgccgttcccccttgggcgatcagaaaatcggagagccggccgagcagcgggttcgcggtaatgccggaaaatccatcagatccgccgcacttcaaaccgattttcagttcagaaagcggaacatcttcgcggtggtcaccttttgcatgcttataaatttcctttaacagtttgacgccttccgtgacttcgtttgatacctcttgggaaagcagaaacttgacccggctgtgatcgtaatcgccgagcgcttcgcggaattcgtgaatgctgttgttttcacagccgagccccagcacaaggacaccgcctgcattcgggtggttgacggcattcgccaaaatcgttctcgtgttgatatgatcgtcgccaagctgtgaacagccgtactgatgctttaatacgtgaacgctttcaaaaggggcgatggagccgacctcagccttaaattctttgatgatcagctctgcaatgccatttacacagccgacagtcgggacgatccatagctcgtttctgatcccggtttttccgtcttttcgtttaaagcctttaaatgtaagcggttctttttgatagcggttttccgtaaacttcggcttgtagctgtattcttcgacaccgcccaaattcgttttcacatttttcgtgtgcacccactctcccgtctgaatcatttcagtggcgtgcccgatcggaaagccgtatttgatgacgttttcattttcagcgatgtcttttaaagcaaacttatggcctttcaaaatcggttccttgatcacgatggttcgttctccgacagtgaccgtttcaccggtctgcaattctcttaacgcaatgccgacattatcttgaggattgatcatcaagcagtctttcattacatgtcccccagctcagccatttggcttttcatcattttttccagcgccttcctcattcccgtttgtttcatgtcccttaaatattcagccgtcttgtccgtcaatccgggcatgtcgttcagattttgcccccacactttttcaaacccaagaacatggaatgcgatgttcgaaacgtctgtctcttccgtccagagccgtttgaggaaagccagcacctcatcgtcgtcagacagcggaatggccccatcatccccatcccgttggcctcggtaaaaataaattaaggcgcttaaagcaaatacggttcgagccggaagtttgcctgttcgttccgcatattccattaagacgggcaaatttctgactttgaattttgcaaaggaatttaaggaaatatcgatcagcttgtgacggataaacgggtttttaaagcggtcgagaatctcttccacgtagttgtcaagctcgctatcgggcatatcgatcgtctcgagcacctcccgctggatcagctctttcacaaatgagccgataagctcgtcttcagccgcttcgcgaaccgtctcaaggcctgccaaataagcgaccggcgtcatcgcggtatgggcgccgtttaaaattctcacttttcttatcctgtacggcgtcacatcctggacaaactcgacattcagaccggcctcatgaagcggaagctcgtctcgaagccatttcggcccttcaatcacgaacaaatgatacggctccgccttcaccatcaaggaatcgtgatagccggccgcctcttcaagccggtgtgcattttctttcgggaatcccggtacgatcctgtccacaagcgtattgcagaacacgtttgcctcttcaagccaatcgatgaacccttgttcaagcgcccacgcgtttgtatagcgcagcacaatgtctttcagtattttcccgttatcctcaagcagctcacacgggaggatcaccagacctttttccctgcttccctgaaaagtcatgtatcgtctgtataaaagtgcagtcagcttccctggatagcttttctgcggacggtcggacagacggtcttcctcgatataaatgatgccggcctctgtcgtatttgaaaatacaaaccgcaaatccggcagatcggccagctccataaattcatcataatgctcatagctgctgacgactctgctgattgatgtaatgacagcagaatcgcgaacctcccgtccttcccggaaaccttcaagataaagcgtgtaaagcccatcctgttcttgaaaggccgttactgaaccgcggcgcggaggcacgacgacggcactgccgttaaaatcggtttcttcattcaatctatgaatctgccagtcaataaaccccctcataaagttaccttccccgatttgcaaaatccgttcggggcggctcggcttagaccttatccgtttggacagcctctccatttcaatcccctcctcatttctgcacacgttcacattttacagcgcatcaaaaaaatgatgctatagatgcttaactgaattgcgaatgatcagctccgtgctgatgagcgtctgcccgccttctgcctgcgggttttcgatcaatgacagcaggctttccgcaccaagcatgctgattttttcagtcggtttttttaccgtcgtcaatgacggtgtcgtatacgccgaaaatccgctatcgtcaaagccgataatcgacatattgtcaggacagcgtttcccgtttgcatagagggcgttcatcgcgccgatcgccatatcatcattggcgcaaaacagggctgtcggaggattcttcagctttagcagcgtttcagccgcgcgaaagccgctttgcatcgtataatcgccttgaacgaggtattcgccgggcatatcaaggtttgagtcgcgaagcgcgcgaagaaagcctcctttcctttcttgagacgatttaaagccttctttcccctgcaccatggcgatctgtttgtggccgtttttgatcaagtatgaagcagcgaggaaagcgccctcgtgttcattcgccagtatattgacaacggagtgcccttcgatttttctgttcagcacgacgaccggaatattctgtttgaggacatgctcaataaaagcctgatcctgttcgctttggctgattaaaatcatgccgtcatagcggttgcggtgaatggatgacaaatcatgataatcgtcgattcccctgacaaccatattatagttttcatcgatcaccttgttgacgccgcgcaggatgtctgcaaagaaacttgaagacgtcccgtctgtcaggcttgttaaaaacaggccgatcgtaaaagacttttgcgtgacaaggcttttcgcattaaaattcggtttataattcatttcggctgcgatgtcgagtattttctttttcgtgttctcttttatcagcggactgttgttcagcgctctggatactgtggtgtgcgatacattcgccagcctggcgatatctttaatcgttactgacattgttttttacccgccttttcttgctgttgttaccatcagtttaccatatcaaaagcgctttttagaaagtgaatttccgctatgttctcgctttgatttccgcgaccatttcggcgtgcttctgatccgtcaaacggtacaggtagccgagaacgagaatggccgccgtcagcgctgctgccggatacaaaaggagaatcgctttaatgccgagcagcgtccccgctttttgggccgcattcggcacatagccgatgatgctgagaccgatccctgacaggaagccggagagcgactgagccagctttctcgaaaaattaaacagcgagtataccgttccttctttccgttcccctgttctccactcgccgtaatcgatcgcatctgatacgaatgcccaggtgattccgttcggaatgctgatgccgatgaaggcgatgcttgcgagaatcgtaaaaacaaagacattgcccggtgcgaaaaaattgatcagatcggcacagacagaaaccgcgagccccaaaatggcggtatgctttttcccaaaaagcttcacgagcttcggcagcatgatgacgccgataaaggatgagccgatgatgatgaaattcatgtaggccatcagttcggcgttcccgaggttatactgcgcgaaataaatcagcatcgcggatttaaggttataggctgaaatcgtaaaaattgtcatgaatattagcgtaaggagcggcttgttcgtaaaaaacgtctttgaaatcgctttgaatgtcactttttcctgtttgtacttctcatcttttacgacgatccgttcctgacagttcctgtagcaaatgtagaaaaacaacacacccagaaaagacatcagccccatgacgaccggataggcaaccgcagggttgtcaaacctgacaatcatcgggatgacaacaatgctcgtcacaaacagggcgcccagcgagccggcttggcgaaaggaagcaagcgaagtccgttccaccgagttttgcgtcatggcagccccgagcgagccgtaagggatgttgacaaaggaatagccgagaccccaaagcatgtatgaggcataagcgtagatgagtttgcccgtcggtgacagattcggcgagatgaaggtcaatatcgtcaaaatcgcaagcacaaagcttccgtatagcagatacggcctgaatttgcctttcgggccgatattcttcctgtagtcgatcgatgttcccacaatcggatcgacaaaagcggcgaaaagtttgctcacaagaaaaatgcctccggctgccgccgccggaatgccggcaacatccgtaaaaaacttcagaagatagagctgtccaaggtcaaacataaatccgttcccaaaatctccaaaaccgtaagaaaccttttcttttaaacttaatttctcttgagtgacggcgactgtttcggtttgtttgttcgtcgatatttccatgaaaaagcagctcctctgctagccaatttgtgaatctaagctttcaaacgatctttcacttcaaactggaaatagtgttttgcattttcgtagcagatcccttttacgatccggcccagcagttcgatatcatccggcgcttcgccgttctcaacccatgtgccgataacatcgcagagcaggcgcctgaaatattcgtgtcttgtgtaggaaagaaagctgcgcgaatcagtcagcataccgataaaacggctcaatagaccgatgttggcaagcgatttcatttgttcgagcatgccgtctttcgtatcgttgaaccaccaggcggtaccgtgctggattttccccggtatccggccgtcctggaagcttccgcaaaggcttgaaatcacgacattgtcccgcgggtttaaagaatacaagatcgtttttggcagcgcatcttttcgatcaagagaatcgagaaagctgcacaaaggctttgcgatatcctgatcattaatcgcatcatatcccgtatcaggcccgagcttccggtacattttgctgctgttgttgcggagggcgttaatgtggagctgcatcgcccagcccttctccgcatagcatgttcccaaaaagtgcaaggtcaaggatttgaatttgcactcttcctcaggcgaggcgctttccccgttcatcacctttgcaaaaatcgggcgcacttcgctctcatctgtttccgtgtacatcatttgattgatggcatgatccgatatccgtccgcctgcttcatggaaaaagtcaattctgtttttaagcgctttcaaaaaatcgtcataattcgctatcttcataccgctagctgtttcaagctttctcacccaggcggcaaaaccctcttgattgatttccatcgccttgtctggcctaaatccaggtaaaacgcttacattaaagtcttcatctttcagctttacatgatattcaagactgtctgtggggtcatctgtcgtgacaaccgtttcaacgtttgatttttcaatcaagtctctggcgccgaaccctcctccggccagctgttcgttaacccgctcccaaatatgcggcgcgctcttttcatcaagccggtcatcgatgccgaaaaacctcctcagctccaaatgggtccaatgatagagcgggtttccaatcgtcatcggaaccgttcttgcccaggcgctgaatttctcctcgtctgacgcatctcctgtaataaactcttcggatattccattggccctcattgctctccacttgtagtgatcaccgtagagccatacttcggtcaggtttttaaacgttttgttttcgtaaatctccttcgggctcaagtggcagtggtagtcgatgatcggcattccttttgcatactgatggtacaacactttcgacgtttcattcgttaaaagaaaatcgtcattcaaaaacggcttcacagaatctccacctttctttatttataaatgttaacgttaacaaaaccatctgcagcataatgtgaacgttaacatttaatcttattttatactaaccgcgccttcttttccattattttctcaacataaaagaagcctaaaggcaataacctttggcttcttctttttcataccgcttatttggcggctttagggtttttcttaaattccatcgtaatttccgtccctcggcctgtccggctgtcaactgcgatgcagccgtcgtgcaggtggacaagttccaaagaaatagcaaggccgagaccgcttccttctgtcgcatcttttgtatgcgttcccctgtagtagcggttgaataaatttgagacggtttcagagtccatgcctcttccgttgtcttgaattttaagaataatatattgcttggattcttcaaggatcaccttgatgtcagtgccttttttgttatgcttgacggcgttggcgaggaggttttccaagactcttcggaaccagcccctgtctatcgcaaactcggtatctacttgcttgtattcaaaagacacgttgtacccttctgaaaatgaatggcgcttaaactcctcaacgaagctctttaaaaacggcacgagcctcactgtctggcgtttaatcggcaaagcgtcgtttttcagcctgtacgtcaagttcaagtcttcgattagctgtgacatgtagtccgacttttctttcatcgcctggccgatttcgcggatttcctcttttgaccactcatagtttggagactccagcatcatgctgtagccgtaaatcgtgctgagcggcgtttttaagtcatgggagagccctgcgatccattcctcccgggtcgtttggattttcttgcggttttgctcgtcttttttcagcgtttccgtcagctgctccatcgattcaaacacttctgtgaacagccggtacggctgttttcgcttcccttttttgttccggcttcgcgggcggcctttccggtttctcggttcttcaaatcgcccttttgaaaggttgacgatccatttaatcgtatggatgatcggcatgccgaatctgaaagaataccaaatggtcatagaagacatcaataagatcagaacgccgatcacgatgagaacgatttttaaagcgagcccgatcatcgtcctgttgaactcatgatccggattaaaaatcgggttcggcgtagcggcgatcagccattctgtcgcgcttaatcgcctgtatgaaaactcgtgctcgtagttccatggctttgatccgtattttaaaagctccagctcattgattccctggctgtaatctatgtcctggtagatcgagtccagcattttccctttttcgctgaacaaatagacggaccctttgtttttcttaatgaaatcaagcgtgctttttttataggaagaaaggtctgccatatccttctcttctttttccaaataggacaggatcgtatcgcttttcgactcccatccgaataaaatcacgtagtcttcaccattgaaattggcagaccagaagttgacttgatattttttaattctttttttatcaaaaacggataccaggtcttccctgtggtactgcctctgaatttccgcaggaagacggtaggaataaacggttttctccttgccgtctaatatttgaagccagcctccctgtttgtcgatagccgatttcaagatatcttcgatctgccaattgttattgtcatccacgctgacccagctttcaaacgtgtctgaagtggcttttgccaagcctgtatccgcttcgctctcgcttaatcggagagcgaaaaaaatgaaggataacagcaaggtcgcgagaacaagaccgagaatcaaaaaaatctgactgacaaagtggagaacgagctttcctctgagcttcatccttcgctctcttttcgtgcaggattgggaacgaacttatatccaaggccgcgaatcgtgacaatatattcggggctgctcgggtctttttcgattttctccctcagctttctgatatgtaccatgacggtgttgctgtctccataagatggaacgccccacactttttcataaatttgatccttggaaagcaccctgttcggatgatcgcaaaaatattgcaggagctggagcagctgcgccgagcagctgaccgtttcgccgtccacgatcagctccgcaaagtcgggatgaaatataaagcgttcatattcgtaggctgaagatactgaagcagctgcaacttctttatgtatatacgttctttttaaatgggctttaatcctggcgattaattccagaggattaaaaggttttgtaatataatcatcagccccgtaggcaaaacccgacagtttatcgagatcggatgttttcgccgtcaagaagaagatcggagcgttggtgtgccgcctgatttcaggagatacatcaaatcctgtctgtcccggcatcatgacatcgagaagtattaagtgcacggtgtcctttttcacgatgtcgagcgcttcttctgcgctgcttgcggtcagaacttctgaaaatccttccttcgtgaggacgcgcttgaccatttgaacaatggcgtcttcgtcgtccacaatcaaaattgtcgcattttccaaaatccttctttcctttctgtctatatcatgtattttatatcctcatcttaccatctattatatctatatcggcacacattttctgattttaaagtaaaaataaacttttttagaaatgattttttactttacgaaatcatggaataaaaaaacagacatctgtccgatgtctgtccagattgttgacaaaatcccaaaaaggtcttttgttattgggattttgtcatccggttgccagcctctgatcctcttcttttttcaatagatcgtaagtcaggcacaccggttttcctgtgcgcgggtctaatataatttcagcatcaatctgaaacaccttttttaatacttctgatgtcatgacttcatgaggggcgccctctttgacaatcgcaccccggttcagcgccaccatatgatgagcgaagcgggcggcatggttgaggtcgtgaatgaccatcaaaatcgttcggccttcttcttgattgagcttttccagcagttgcagaatttcaagctggtgcgccaagtccaaataggttgtcggttcgtcaaggagcaagagctccgtttcttgggcaagggccatcgcaatccagacgcgctggcgctgtcctccagaaagggcttcgatcggccggtcataaaaaggcaacattcctgtcacttggagagaccattcaaccatgcggcggtcatcggccgaaagcctgcccattcccttttgatgaggaaaacggccgtaagaaacgagctcatatacggtcaaaccgcctggcgcctcaggcgtctgcggaagaatcgccatctgtttggctacatccttcgtcgacatttggtggatcgctttgccgtttaaataaacggcgcccgttcgcgaacgctgtatgcgcgccatcgtttttaatatggttgatttgccgcacccgttcggaccgatcatggtcgtcacttttccttttggtatgtggaggtttaagttttcgacaatcatctgttcgccgtagccgatccccaggttgtttgttgaaagagacacgttgcacccttcccttctttaatttgttttcataagcaaatagataaaatacggtgcgcctaaagcggcaatgacaagccctacgggaatttccgaaggcgccagtatcattcttccaattaagtccgccagcaaaaagagcaatgctccggtcaacgcggaagccgggattaaaagctgatgcttcggcccgacaagtcttctggcaatatgcggagccacgagaccgagaaacgtaatgtttcctccagccgctacacacgcgccgctcagcgcggctgccgacagaagcagtgtgcgccgctctttttcaactgccgttccgagccctgttgcgagctgatcaccgagattcagcacgtttaaatagcgcgctttatagaggataaaaggaatcagcacgacaatccagggcagcacggccgagacaaagctccagttcgaactccatatattccctgacagccaaacagccgcctgcataaagtcatttgggtccattttaagctgcagcattaagatggccgccgaaaacgccgcattcactccgatgccgaccaaaacgaggcgaatgggattcaagccttttttccacgccagcaaatagatggaaacgactgcaaagcaggctcccaaaaatgcgaatatcggcagggaaaaaacgaatcctttttgcaggttgccaacgtctccctgaaaatagaagatgaacagcacaacggcaaaacccgctcccgtattgatgcccaatatccccggatcggccaggtcattccgggatatcccctgccagacggctccggagacagcaacccctgcaccgatcagcatggcgaggatcatgcgcggcagacggaattcaaataatacaagttcatcctgcggcgttccaaagccgaacagtgttctcaatgtagcaagcgggtcgatgcggatttctcccatgttcatgcttaataaaaacacggcggccgtcagcacggccatgacgagcatcaccgcacccgcccgtctgttgtttttcttgagcattacagtccactcctttccctgcgggccagatagagaaagaatggtacgccgacaagcgcagttactgctccgacaggtgtttcaaacggcgggttgaccagccttgccgcaatatccgcatagatcagaagaacagcgccaagcacagctgagcatggaatgatccagcggtaatcaaccccgaccagaaagcgggtaatatgcggaatgatcaatccgataaaaccgatcgcaccggcaacggatacagtggcacccgtcagcagaacaacggacacgatgccgatcgcttttaccgtcttcgtatattgaccgagccctttcgccagctcctcacccaggcttagaaccgtgatggaacgggcgatgacaaaaacgaccgccaaaccgagcgctgccgccggaatcaacaactgaatgctgagccatttcgtgccggcgacacctccggcataccaaaaactgacgtcgcgcgccacatcaaagtggatcgcgatgctcgtagaaagagcgctcaggaacgtgccgacagccgtaccggccaaagccagctttacaggcgtaagaccgccttttgaaaacattccgattccaaaaacaagccccgctccaagagcggcaccggcaaatgaccagatcatcagcccgatcgatgaggttcctggaaaaaaagcaaacgcaacagcaattgcgaaagctgacccgtgcgtgacgctcataatttccggcgacgcaagaggatttcgcgtcatcccctgcatcacggctccggaaaccgccaggcaggcgcccacaagagccgcacttaccgtccttggcagtctgagttcctgaataatttgatgggccgtatttttcgcgtcaaaatgaaaaatggcgtcccaaaccgttccaagctttatatcagccgcaccgagcgcaatcgataatgcggcgccaaaaagcagcagcatgattccgccggccaggacaaatacagctccgagcggacggctgatcggtctctgttcttcatcagtgccatccgcgccgttgatatgatgtatgtttttgtaagagctcactcgatgccattcctttcgatctttttaaccgataacgattatcattttcatgtttagtataacaggcctaagcaaaaattttaatcaaaattttcggcaggaatcaaaaagccagccgatcttccgctaaaagacccggctggcaaagagctttatcacacttgattatttttgaactttttgtagacgaacgggtagatcgcaagaccgacgaaaaacagcccgattcccaagataaaggtggtcaagtcagacgtgcctgaaacgatgacccataaagagtacgcaagagcggccaaggcaatgatgccgtctcctgttcttgaacctttcagctcgccgtatgtctcccctttgaggatgagcttcaagctgaaaagagccgctatgagataagggacaaggtaagcgagcgtcgccgacgttgttaaaaacgtaaaggcttcgctgatcgttcccgaaatcgttgagaaaataaagatctgcgacatcacgtttgtgacgatcaatgaattgaccggacttccctttttattcgttttcgcaaagaaagcaggaaaatcaccggcttttgccgcctgatacggaacctctgcgccgattaaaatccagccgagcatcgatccgaacaaagaaacgattgccaagaccgccataatcacgctgccgaagctgccgataatcacgtgcagcacatcaacgaacggtttatctgatgcctggagctgatcgtgcgggatgacgcccatcgtaattaaagtgatgatcatataaatgccgagcgcaattaacaggccggtaatggtcgcgcgtttgacatcacgctgggatgatgcgcgccctgataagattaccgcagactcgatgccgacaaacgcccacagcgttgaaatcgccgcattgtgaacctgtccgcccagccctatgcttttgccttctgattcgattggaaaataaaatgattcgaataatgccgtttgaaaaacgaacaaacctgcaacaataaacaggacaaacccaagcactttggaaaaagtcgccaaaaagttcagcttgcccgctccatttatgctggagactaggataaaatgcgtcccccataacaaaatcgtacacacgatgaatgtcaagagctggccaagtgtaacggggtgtccgccgaattcaaccagctcgcgtccgtcggttaagatcggcaagaaagtcgtcaaatagcctgcaaggcttgtaatgatggccacgttgctgatccagctagccacccaatacccccataccattgtaaaacctgccgcattcccttttttagggtctgagaataaagctcttgcatagctttgcggacctgctttgagatccgggcggcgaatggataaatggccgaatacaagggcgatcatcagcacccccgcacccgtcaccagccatgccgccgttacgccgagcgggctagccgtctgggcgagtgtgctggggagcataaaaatccctgagccgaccatattgccgacaacaaaagccgtaagaagccagaagccccatttttttgtctgttccataagatataacctccgagcattttataaaaaatatgccggaccagaccgtgagatcattcaaaataaaaaaagcatgaacaaaagtccatgctttggttaaacatacactcttgatctccggatagccctccgcgggaatacccgcggcagtcctgcacttattcaatgcagacccagcataaagaatgaatggcttccttatgcttcggcgctgatgccttttgcatatgatcatcggccccatcagcctcacacatgcgactcatcatccgcgcaacctctacctcactaagagttaagagtgaggatttatcacatattctgaaaagaggttaccagagaaattttgatctgtcaaagggaagtgatggaaaaaacggacagccgcgccaaaaggccgccttttttggcagccttctgaagaatggaagacgggctctctccatctgtcatttatcggttatttttctttttgttgaccgcctcttgcagagggtctcctttcagcgcttgtcctgcgtcttcaagcgccccccgaacggcgttttggtccttttccttatttcctctatctttattgaagaaaatacccaaatgaatcacctctttaaaaatgtggtacaattttaatttggcttatcaaatttaaattatgcagaaccttggaatgtgttttttatctgaaaacgccatattttagatgtaaacgcgccgattgtttaggaaaatgtttttttcagctgacaagttgttaccatctgtcttgaaggccgtcagaactcttgatatagttttcattaggaaattgttataggtcttaaaggagaagcgatatgacaggaaaaacacacatcatgggaggggtcgcttcttgtacggctgctgcttatttttacggatatgatccggtgttcatgacagcctcgggcgttatcggagcattgattccggatatatgccatacaaaaagcaagataggcagaaggcttccgattttatcagcagtggtcagttctgtcttcgggcacaggacgtttacacacagcctgctctttttgctcatcacggcattcgcgacacatttatattttgcagatcagagcatacttgtcggattgatggccggaatggcaagccatctgctcctcgatgccgggactgtaaacggcatcaaacttttctttccgtccgccattaaggttcgtctgcccctttacattaaaaccggcgggaaggcggaacaagtcgttcttgctgtgctcaccgttgtttcgtgctattttattgcgaacttgatcgcctgacgaaagggacggtttgaccgattgctatatgatgctttttttagtcattttatcttggtgttctttacctgcggggattatatgtgaggagctatttatatgaaagaacaattttttaaaaagcagtggtttttatgcctatccatatttttcatatggatgaagacgtacttcatctacaagctgggctttaatttacaaatcgacaacgcacttcaggaactgatcctgtttatcaacccgcttagctttctcatccctgtactcggcatcagcctcttttttcgcgaaaaatcgcagcgcatctatttaatcggggctaatgtcgtcctgacgggcatcttgattgcaaacagcattttttatggtttctacatcgatttcatcaccattcccgtcctgttccaggcaaaaaacctcggggggcttggaagcagttttcaggagctgtttaatccggttttcatcgcgcttttcctggacctggctctcatggtctggctggcaaaaacgcgcgaaagaaccggcaaaaagctttccgctaaagccgttaagatctactatgcggcagccgccggaacggtgctgtttaatctcgccctgtcggagctggatcagccgaagtttttaagctactcttacgacagggaagtgcttgtaaaaaatatcggcttgtatcagtttcatctgttggacggcatttcacagacctttaatttgacacaaaaagcggtcgctgatgaaaacagcctggcaacgatcgaaaactacacaaatgccgactacagcaaaccgaaccaagatatgttcggaattgccaaaggacgaaacgtcatctttgtaacgcttgaatccacccagacatttgtcatcaatgaaaaggtgaacggccaggaaatcacgccgttcatgaacaagttcattcaaaaaagctattatttcgaccatttttatcagcagaccgaacaggggaaaacgtccgattcggaattcattgtcgctaattcgctctatccgtctctgagcggttcggtgttttttacgaagagcgagaatgcgtacaattcgatgtataaaacactggcgaaccacaattacagaacatcggttttccacgccaaccataaaaaattctggaacagggacgtcatgtacaaagccctcggcatcgacagcttttatgacgtctcccattttcatgtgacacctgaaaattcaacgggctgggggctgaaggataaggagtttttaacgcaatcggccgacttgatgaaagacttgccgcagcccttttacagcaacctgatcacattgacgaatcattttccatttcaaattgatgacgaggataagctgatcgatgagtacgattcagagagtgacattttaaaccggtatgtcacgactgtacgctatgaagacgaagcattgaagcatttcatcgcaaaactgaagaaaaacggcctttacgacaattctgtgatcgtgttcatgggagatcactacggcatatcagaagcgcacaacgatgcgctggctcaatttttgggcaaagacgaaatcaccccctacgataccgttcagctgcagcgggtgccgctgattatccacattccgggggtaacggatcaagacccgaaaacgatatccgaaacaggcggccaaattgatgtcaaaccgacattgctccatttgctcggaattgatacaaaaggcatgattcaattcggcaatgacctgttttcgaaagaaagaatgcctttcgctgtgttgagaaacggcagctttattacagatgattatatctacacgaaaaatacgtgctacagcaaaaaaaccggggacatgatcaacgatggagaggacaaatgcggccctctcatcgagaaggcgaatgaagaactttccctttccgataagattattaacggtgatttgctgagattttacaaaaaataatccgtcccctttaaaccggcattctcgccggcttaaaggggctgtttaaattgagggacagctgggtattatataccgaatgttaaaaatgaacttgcggttttgcagttccttcgttaccctaaatgaaaagagaagttatttcgagtgccgattatttcataaagtgttataaaaaatgataaataagaaggttttaatatgagtgaaacacagcacaagacaaatcaattgccgattgttgccgtcttgattatggggacatttatcgccattttgaatcagacgcttttgacgacggctctgcctccgattatgagggacttaaacattacgccggggcttgcccaatggctgacgaccgtttttatgctcgtgaatgggatcatgattccagttacggcttttttaattgaaaaattcacaacgagaaagctgttcatggcggcaatgtctttatttacggccggcacgctgatctgcgccttgtcattcagctttccggcgctgattgcggggcgcgtcgtgcaggcggctggcgccggcattatgatgccattgatgcagacggtgcttttattgattttcccaaaggaaaaacgcggatcagcaatgggaatggtcgggcttgtgattgcctttgctcccgctgtcggaccgaccctgtcaggctggatcgtcgatcgctatccttgggaagtattgttttacctgctgcttccgttcgccgtgatggacatgattgccgcgcactttattttaaaaaatgtcaccgaacagacatcgcctaagatggatgttacttcaatcatactgtcttcgcttggcttcggcggcattttgtacggcttcagcagcgccggtgttgccggctggacgggtgcggacgtgctggccggcttcgcggtcggcagcgttgcgctgttttggttcatttggaggcagctccatttggaagagccgattttggagttcagggtatttaaatatccgatgtttaccttggcgacgattatcgggatggttgtctttatgtcgatgatcggagctgcgacgatcgtgccgatgtatatgcaggatatgcgccatttcacggcgatggagtcgggaatgatgctgtttccgggagctgttgtgatggggctgatgtctccgattaccggaagaatttttgacaaaatcggcgcgcggattttgagcatcaccggtttgacggcgatcttcgtgaccacattgctcttgacccatctgacaaagacgacgccttttgcatatttgtctatcgtctatgcgattcggatggtcggcatggggatggtgctcatgcctgttacgacagccggcttgaaccagctcccgcgccatttgattcctcacggaacggccatgaacaatacaatgagacagatgtcaggatcgatcgggacggctgttctcatcaccatcatgacacagcgtgcgcttcttgaccctgccggtccgtcttcggatacagcgatgattcacggcgtcaatctggcatttatgaccgctgctgcattgtcgggaatcggattggttctctcattctttattaagcagcaccgccgcggacggctcgacggcagcaaaagaaaacaagcgaaaggccgcttggccattcatgagaaatgaaaaatcccgggtttataaaaacccgggatttttttatgattattcgaatccgttaaccattgtgtccggatccggaccgacgcgctcatctttattaagagcgttgattttttcgacatcttccgccgataattcaaaatcaaaaatgtcggcattttcaataatgcggtgttctttgatggacttcggaatggtgacgacttcattttgcaaatcccagcgcaggatgacttgagcaacggatttgttgtattttttagcgatgtcagtcagcacctgatcatcgaggagttttccctgcatgagcggagaccatgcttccacctgaatgccttgcttcttgcagtagtccctaagctcagtctgagtgaggcgcggatggaattcaacctgattgaccatcggtttaatttccgcatcttccaataagctttccaaatggtggacattgaaattgctgacgccgatcgctttcactctgccgtctttgtacagcttttcaagtgcgcgccacgtatctttatatttgtcttttcctggccaatgaatcaaatataaatcaaggtagtcaaggccgagttttcgaaggctttcatcaaaagccgccaatgttttttcatatccctggtcactgttccaaacctttgacgtgatgaaaagctcttcgcggggaacgcctgattccttaatccctttgccgacgccttcttcattttgatagatagcggctgtgtcaatgctccggtatccgtttttaatggctgcttttacagattcaacgacttggctgccttcttccactttgaaaactccaagtccaaaccatggcattttcacaccgttatgtaatgtcacagtgtcctttaaactgcttaccattttgaacgaccacctttctttttttcagatgcttttaaacgcaccgcttttattatctcatactgggtggattttacaaaacaacttgctcaaccgatggaatgagccaaagcaagcgctccggtgattccctgatcgtcgccaaggcccggcggcacgatgtattcttcaagatcaggcaggtcgacatatccgttcaaatattcggccagctttttgcgaatcagcgggaacagctgctgctgcttcatgacaccgccgcccatgatgattttttcagggcacagaatcaagatatattgcatgagggcctgtgctaaatagtcggcttcaagctcccaaacttcctcgttttcagccaaatccttgccctttttcccccatcgcttttcaagcgccgggcccgatgccatcccttcaaggcagtccttgtgatacggacagattccttcaaacgtatcctgcggatgccgtctaatgagtaggtgacccatttcaggatggagcgtgctctgtacgagccggccgccgacaatcgctcctgctccgattcctgtgccgactgtgatatacaagcagctctccaggccttgcgcctctcctttcgtcagctctccaagtgcggcagcgtttacatcagtcgtaaacgaaaccggaatgccaagccttttttccaattcgggaataaacgggtaccccttccaggctaatttcggggtattggttatgtatccgtaatcctctttattttttgcaacggatataggtccaaaagagcccactcccattgatgtgagctgatacttgctgaagaaatcggtcagctttccaatggtctcttcaggcgtctccgtcgggatcgtcagcctgtctatgatttctcccttttctgttccgactgcacaaacaaactttgtgcctcctgcttctattgcaccgtaatgtttcatcctctcggctccttttcatctgtttgaattgctctaattgaatcataaatcagacgatgaaagaaagcaatcgcactgaacaatggttcaccagagcatgggagcttttgatgctgacggaagaaagcttcccgaaaatgtggcagttttcaaacaactgccgcgttcgctttttcgcttaaataggcttctgaccgcttgatcgtaaccgtgaaaaagaggattttttcaagccccgctcgaagctttaataaggagggatatcatgaagcatccattcgacaatttccgttctttattcccgaaattgtctgatcatgttcatcttgccgcatgttccggaagcgcattggctctgcctgttgccaaagcggtcgatgagtatcagaacggccttttaacagccggtgcagactggaaagcacatctcgacaagatggatgagaccaaggaaaaattcgcccggctgatcggtgctgaaaaagaagagatagccgttttgccgtcagtatctgacgcagtggccgctgtggccgccgcaatgccgcagccaccccgtcgaaggcagatcgccttcacggatatcgattttcctgctgtcggccaaatttggcttgcgcaagaccgcttcaaagatcacctcatcatcattcaaagcgaagatgggatgattgacttggaacaatacgaaaaagacgttaccgatcagacgctcttgacgtgtgtgccccatgccggctatcggaacgggtttaagcaagacataaagcagattgccgagattgttcatcagaaagggtcgcttttattcgtcgacgcctatcagactgccggccacattccgattcatgtcaaagacatggatatcgacatccttgcggcggggacgcgcaaatacatgctcggcattcccggaacggcttttttatatatgaaacgcgaactttgcgaacaatttgagccaaaaacggccggctggttcggaaggagcgcgccatttgccttagattcaggctttgcggaaggtgcgaaacgcttcgagtcggggacaccgtcatttatcagcatatatgcggcagacgcggcattgaagctgctgcttgaagcggagcccgacaggatcgagccctatctgcggcagcttgcggcattctctttgcaatacggtgcggaaaaaggcctgaagatcacaggacccaacaccgtacataacagaacaagcctgatctcggtgtatgccgaagaagccgcccgtgttgaatccctcttgcgtgaaaagcatatcatcgtctcaaagcgaaacaacgtcataagaatagccccgcatttttacaatacaaaggaggaaatcggatttgtgatggatgagatcgcggcaatcgtaggctaagcccccggctttaaaatggacagaatgcgattttttccttaaactataaaaaacaattttcatcaaggaatgagacaaaatggagctttatatcgaaggtgaattagaagagcataggaagctgccgcaccgaaaagttttgtttgccattttggctgttttgctagggtccgggattaccatcggatatatcgtgtatacgcatttttattcgatgaatcatctgccgaaaggaaattggtttcagtcttccgcttcgccgaatcaagcatacaacctgaatttgtatagagtgaacaaaggcgggggaacgaactccccttccgtcagaggggaattgacaacggttgccaccggtgaacgaaagaatatctattggggatacgaagaagaacatgccaaaatcgaatggcaggacaaataccatgtgtccatcaacaacaatgtgctggacgtcagaactgatatatatgatggaagaagagagtgacggcgtcactctcttctcgtgtacatatcatttgggacgccgtttaaaaaatgcgtttcttttccaatggaaaagaggtgcagctcatgcatcgccctcgtgcacgccgtataaaataaagtccgctctctttcctttttgtattgcttttcagaagcgtcataaatgatgacggcatcaaattcgatccctttcgccaaatagacgggaatgacgaccacgcctttttgaaacgttctcgtttctttatcgatcagtttaagctctgcatgctgctgaagatgctggaacgcatccctgcattcccggactgttttacagatgactgcaatcgtctcaagtccttctttttgaagggcggtcataagggaagccatctctttatggtgtgcatgaggatcggctgatattgtcaaagtcggttttttgccgttcctattaaaagcttcgatctcttcgcccccttcgatgatgcgctttgtcaattcaacaatttctttcgtcgacctgtagctgcgcttcaaggtgatgatctccgttttttcgccttcaaacacgcctcccgacagaagcgtcttatcgtgataggcatgggcaagaatcgcctggtttaagtctcccagcatcgtgatgctgcacgcgggaaacaagctctccaaaaaagcaagttgaaaaggcgtgtaatcctgggcttcatcaatgaataaatggcggattgccgtgtttttccccccgcctttcagcttgtttttcatatataaaaaagggacagcatcttcataaagcagcttctcaaaacgaaagcttttctgagtgaatgtgcaaatgctctgccagtcatcagggcgcgtttgcggggtatagcgtccggaaaaaagctgaaggtatgttcctttaaaatcaataaagccgaacgcttttaccacttgcttgagcggcttgaactccctttcggcaacgatggaggcaaggaggtttcgctccctttcataatcgtcaaacgtattctccgtaaagcgctgttcctcctgaagacgtttataagcctttaagtattcctctttatccagcagctcgctttcttcgatgacccagtctttttttctttcctggcgttcatatttattcaggagctgcaacagccattttcccgtttgttcaatccggttggacagcgtgtctgaatgatcaagggccgcgaaaaatttccgcatctgaccgcttgtgatgatcctttttccgcgaaaggtgatatgtttaaacaccaggtgcccttttgccaaatatttgacgtaatcatcgatgatgcctttgaaagccagactggatttcaattcaatcgatttcatccggatgcgctgctcctcaccgtctgaagcggttaaacaatattcaagctgatcgaacggagtctcgcatggtacctgctttccaaggcggcgcgctacaaattcctggaacgtcgtctgctggatgttttcctctccgagctcaggcagaacattggcgacatagctgttaaaaagcaggtttggagagaatagcagcatctggctcgactcgatctgcccgcggccgcggtacagcaaatatgcggcccgctgcaatgccgccgacgtttttccgctgccagccgctccccgaacaattaaaaagcggctcttttcgttccgaatgatctgattctgttctttttgaatcgtcgcgacgatgcttttcatctggatatcggcctgctgccccagcacttcctgaaggacttcatccccaatcgccatatccgtattaaacatcgctttcagctgtccgtttttgaagagaaattgccttttcagctcaatcgttcccctgaccgtctcgtccggaacttcgtattgagccgcgccgggtccatagttatagaacagactggaaatcggcgctctccaatcatagatcaaaaaccgctcttctttttcatacattaaagaggcgagtccgatgtagacggactcagcgttttcttcgccgtcctccaaaaaatctacgcggccgaaataaggcgattctttcacttttaacaggtttttcagctggctgtaaaactgcttatggctcctttccctctcagccaaaacctcagcctgctgtttaatgctaaaaaatgtttcaaccgcttcattttcatcggctatgtttacggtgacatcgctccaaaaatgtttccgtaaatcgatgatatcctccttcaatccgccggtttttccctttagagaatgaagcttttgatccaattcctttaaaacaagccggattcgtttttcctcttccagccattcctgaccgttttcctgcacgctgaccactccctaaaaagatttgacatcgaaaaagattcatgataaaataaaaatggataaaattataattattgaaattttatgttaaaatacacttcatcttatcatataacctttggtcaaatcaatataaaaagccgatttttcaatcaacgaaaaatcggcttttttctattcagctgtgggaccgcagcgaacggttcggcagcttccagttgaacatgtacgaacatacacggcacgcgaccagcaaagcaaacaggatatacaacgtgagcggcttctccgcccagcccatgccgataatgaatccgcccaaagcggcccaaacggcgtaaatctccgttttcagcacaagcggctttcttccggccagaaggtcccggatcattccgccgccgcttcctgttaagaccgccgcaacgatcactgcgctgaccggatggttcatgtgaacggcataaagggctccttgtatcgcaaatgcggcaagaccgatcgcgtctgaaaagctgccccagatgctccagtgctttaacaggagcttcggaaacaaaaaaacgatcgtgatcgagacaagagagattagaaacagactcccctgctcccacaaggcggacactggaactccgatgagcaggtttctgatcgcccctccgccgaacgctgtcacaatccccaatatataaactcctaaaatatcatactcttcttccattgcaacgatcgctccgctgatcgcaaaagcgacggttccgatgatgctcaacacttcccaagccatctaagatgtcctccatactaaacttcaatctttttgattttataacttctccaacctttaaatcaaccctctctgaatcaaaatatcttataatatagaaagatgtttttaaaggggtggaaacatgggacaggaggtcatcatcgaaaaagcgaaagccgagtgggcgcacgaatttgaagctgaaaaacaacagctcgcagatgtcctcggaaaaaaagttctcgctatcgaacaaatcggcagtacctctgttcccggccttgcagcaaaaccggtactcgatttgatggccggcgtgagcagtctcagcgaagcttcagttggatcgaaccgcttcaggagctcggctatgagcacgtatttcacgaagccttcccagccaggcgtttttttcgaaagggaaagcggagggcgggcacacgccatctgcacgtatacatttttcaaagcgaagaatggaaaaatcagctgagattccgaaattatttaagaaagcattcagtcgagcggcaagcctatgaaacattgaaaaaaacttggcgcggcgttttccatattaccggactcctatacaaaaggaaaagaatcggttcatcacagccgtgattgaaaaagcaaaacattcggaaaggagcggcacggcatgctgaaaaagacaaaacataaactgcttactatagccatcgccttcattatggcggttttgttgtactactatgtccaagttacgaagtgaaagcgggattatacgtgcaaggccattctgactgttttgaggatatgcccttcgaaatcttcatcatattcggcgacatcctcaaaacccttcgccttgtaaaagttttttccggtgcggttttctttttcaacctctacaaagatctttttcactccctttaaatggttcatcccctcttccaataatgcggttccgatgccttttccctggtattccggagctaaataaacggctgcgagataggctacccctccttctctgacaaaggagtagttggcaaagccgacgatttttccgtccgcttccgaaacgagcattaacgagtgttccaaacgctgctgcattctttcgtcattgtacgctttctgcaagaacttctcttgaatatcgaaaggaatgatcccttcatacgtatgattccagcttgttttggcaatctgctgtacttgagggatgtctttctttttcattttgcgaatcttacactccatcctcatcatccttcacatctatttgataatttccaaatattataacatcctttctattgaacatgtataagaaataaaaaaagagcattgtcagacaatgctctttttactcgtctttccccttgagaaagcacataaaaatgataatcaaaataaatgcaataagggcgagaaacggaatcgtgatgaaaccgaaccaattgatatactgccctgagcaaggcactcctgtgacacacggtttaatgccgttgaatccgggaattttttgttccatgtagtgcatcagggaaatgcctgcgccgatcaccgccatcggcagcacgtattttttcacacgggcatcgccctgaaatgtcgcaattccgagaatcagcacgagcggatacatcataatccgctgataccagcacagttcgcaaggaataaatttacggatttcgctgaagtacaagctgcctagcgtcgccgttaatgagacgatccaggcgccgtacagaaaaagcagtttatttttcatcagactggcctttcagctctttctcgatcgtttctttgattttgtcataatcaaacggtttgtcgatttttacgccgttgacaaagatcgtcggcgtcgagtctacaccgtatttgttgatgagcgaattgtccgtttttaattgctcagcgaacgttttgtcatttaagctgctgacaagcttatcgcgtttgattttcgtattggcttccgtgatgtccgccaattttgccggcgtcgcccactcgttttccatcgtgtcattgtcaggctgcgccttgtacaacgcctcatggaacttccagaatgaatccggatcttccttccatacctgctcggaagcgagggcgctcaattcagagcctctgccgtgctgttcattgacgaagttaatatatgaaaaattaacttgatctttatcgatgtaatcctttttcaaatccggaaagacggtctcagtccactgtttgcagctgggacatttgtaatctccgaattccgtgatcgttacagccgcatctttgttgcctagaagcggctgtccttcagttgaaggcttgtcatcaaaggtttgcgaagcattttgggtttgattgttgattacgacaagtgcgccgatcagaaaaacgaccacgactgtcataatcactgcaaatttcatcggtgactgctgtttcttcttcacttagacacctcattattcttattttttagtatgccagtttgataacctctttcattttaacaagacaagccgcattcgtgaagatgctaaaaaaggaatttccagttcattaggtggtaaaaaagttacatttctttcacttttaataccctcatcgcatttaaaacagccagaagggtaacaccgacgtctgaaaagacggcttcccacatcgtcgcgatgccaaaagcacccaggatgagaaaaactcctttaacgccgagtgcaaaaataatattctgccagacaatcgtcctcgtccgcttggcaatgctgatggcttccgcaatttttgaaggctgatccgtcatgatcacaatatcagccgcttcgactgccgcatcagaaccgaggcctcccatggcaaccccgatatccgctctcgccaagaccggcgtatcgttgatgccgtctcctgcaaaaagcagcttttcttttggaagtttttgcttatctaatgtttcaatacggtccaccttgtgctgcggaagtagctccgcatgcacttcatcaatggacagctgttcgccgaccgcctcaccggtgtctttcgcgtcgcccgtcagcatcaccgtttttttaatacccgcttttttcaaagcggagatcgcacgcttggcatcctctttgatttcgtcagcgatgacaatcgagccgataaacgtatcgccggcggctacataaacaacagttccgatttcactttccttttgatactgtatgccggctttcttcataagcttggcattcccggctaaaatgacggctccgtctacaaccgctctgacgccgaagccggccgtctcgctgtaatctttgatgcggtccgcttgtacttccttcccgtatgcttcacggatcgactcggcgatcggatggccggagaaatgttcggcaagcgccgcatattcaagcagttcatcttctttgacatggcttgcaggcgacagcttgacaacggcaaattccccttttgttaaagtgcctgttttgtcaaaaacggcgtatttgacatcattcagcgcttctaaataattgccgcctttcacgagtatacctgcttttgacgccgctccgatgccgccgaaaaagccgagcggaatggaaacgacgagcgcgcacggacaagaaatgaccaaaaagacaagggcgcggtacacccaatctgacagcagggcgcctgaaataatcagcggcgggacaaaagcgagaagaagcgcgattatcacaacgaaaggcgtgtaatacttggcgaatttggtgataaaattctctgttttcgcttttctgctgctggcattctgaacgaggtcaagaatctttgaaacggttgattcactgtattctttgtccacttccacttcaagcacgccgtttttgttgacaaatccgctcagcacctctgttccgggagcggcttctctcggaacggattctccggttaatgcggacgtatcgacaagcgatttgcctgcccgcactttgccgtcaagcggcactttctctcccggcttgacgatgatgatatcgccggctttgacctcatcgggagacactttgaccgttccgccttcggtttgaagattggcatagtcgggacggatgtccatcaaatcgctgatcgacttccgggagcgggtgaccgcggctccctggaacagctcgcctatttgatagaacagcataaccgccacaccctcgggatactgctgaataataaatgcccccagagtggcgatcgtcattaaaaagtgctcatcaaaaacccggccgcgaaagatgtttttgacggcccttaatacgacatcgccgccgatgatgaggtaagctaggaaaaaaagaagccactcggctgcggtgccgccgggaagcagaaagcccgccgcaccgagaacggttcctgcagcaagccttgcaaccgtttttttaaaccgtccgtcgctttctggtggggcctgttttgtcccttccttcagcgtcgcgttgacgtgcggttcgatctcggttacttttttctttattattaaagaaatgtcttcgccgctgttttggtcgacttggacagtcagcgtgcttgttgcaaaattgaccgaacacgcttcaatccccttcataccggctatctcatgctcaattttttgtgcgcaattgctgcagtcaaggccgtttagcgtgtactcctgtttcaccttttccatctctctcacctttctttttcagcgccggctttattttatatatgagcatatacgcatatattatctacccttattatatgcttcatccgaaaaatgtgtcaatcgatctttgttatcatacgcaccggctgtttccgtgtttaccctgatccgcgtctgcgaaaactctgctggcatattggaagcaatgcccaaatatacttagtttagctattaaactaacaagcttttttcataaggagtgagcgcttttgaaaaaatcgtgtctgatgatcgtctgcctcgcctttcttcttgctttttccgcaggctgcaaaagcagcaccggcacaaagcatacggaagaaataaaagtctgggattactttaccggcaagcagcaggatctttatcatgagcttgtcgaacagtacaatcggtcccaggaccggtacaaggtcgtaacggagtacattccttttaatgaagtgaaaaagcagctgtctgtcggtacagccggcaatgccatgcctgacgccgtattccttgacaatgtcgacaatgcttcattcgccgctatgggcgtgctcgaagatttgacggagaaaatcgaacaatgggggcaggctgaccagttttatgaggggcctctatcatcagccggatatgaagagaagtactacggcatccctttcgcaagcaatgcgcttgccttgttttacaacaaagacctcttgaagaatgcagggatctccaaaccgcctgaaacgtggagcgatctgaaaaaagcggcggaaaaaacgagcaaaggccaaacgaaaggatttgccctgtcagccgtaaaatcagaggaaagcgcttttcaattttatccgtttcttttgtcttccggagcagatctaaaacagctgaattcaaaagaagcagcctcttctcttcagtttttaacagatctgatcaagaaaggcgcaatgagcaaggaagtgttaaacgccacccaggatgatctggccagacagtttgcagcaggtcagctcgccatgatgatcaacggctcctggaatattgaacggctggaagaagccgaagacttaaattacgggattacctatatcccgaaagatcaaacattcgcttctgccctcggcggcgaaaatattgccgtcgttaaaggaaaaaacaccgccggcgcctgggattttatcagttggctgatcgatccggagcggctcgaaacgctgacagcagaaacaggcgtgtttccgccgcgcaaagatttgctcgaatcatcgagccattggaaaacagatgataatttaaaagccttcattccaatcatagagatcgcatcagcccgcggcccttcgaaagactggccgaagatttcggaagctttgcagactgccctgcaggaagcattgagcgaaagcaaaacgccgaaagaagcgctggatgaggccgcgcaaaaaatcagcgccttaaactagctttaagcgcacgaaggagttttgtcatgatcagagccattgtccgtaaatgggaagggtacttttatttgtttccggcagttctttttatgcttgctcttatcggttatcctctcatctacaacatgattctcagctttcaaaacgtatcgcttgcaaatatagcctcacacgatatcagctttatcggaatcgaaaattatcagcggcttgcccaggataaagtattttgggcatctttaaaaaacacgctgctttacacggccggaagcgttgtatttcagtttgcaatcggctttttcctcgctttgtttttcagcatgaagttcaggcttgccccgtttctcaggggattgatgatggtgagctggctcatcccgctgacggttacggcgcttttattcaagtttatgatggcttcaaacgaaggagtgttcaatcagctgctcctatcatggggaatgatcgacaccccgatcccctggctgtcagacccgaatatggccatctggtccgttatcatcgccaacatctgggtcggcattccttttaatatgctgctcatatccgctggactcagctcccttccggaagacgtctatgaaagcgcaagccttgacggcgccaatgcttttcagaaattcatccatctgacactgcctttattgcggccggtgatcactgtcgtcatgatgctcggcttcatttatacgttcaaagtgttcgatcttgtgtttgtgatgactggaggcggtcccgtggacgcaactgaagtcctgtcaaccgtcagctaccgctactcctttgacgaatttcaattcagcatgggcgcggcaagcgccaatgtcctgtttcttattcttcttttggtcagtctcgtctatttgcggctgatcaaaaaagatgaggtgatgtcgtgaaaacgaaccaaaaggaatggctctttaacattattggcgtcctcgttacggccggctttttattccccgtttactggatgattgctacggctttcaaaagcgatgccgaattgtttaaaacaccgcctttattgtggcccgagacattccgcacggccggctttgaagctgtgttcacttctggcgtcgccggatactttttgaacagcctcctgatttccggggcggctgccgtcatcgttctcatattggccgttccttccgcctacggcttggcgcgctttcggatcaagggcaaaaaaatgttcattttactgtttctcatcacgcaaatgctgcctgccaccgttgttttgactccgctgtttatcgcctttaatcaactgaacatattaaatacgtatatcggaccgattttgacgggggcaacgctcggcgttcctttttctgttttaatgctcagaaccttttttcttgggattcccaaggaccttgaggatgcggccaaaatcgacggctgcagccgttttaccgcgttcatccgcatcattttgcctatcagcgtacccgggattgccgtcagcggagcggtttctttctttttcacatggggagatttgatttacagcatgacattcaaccgaaatcaggagctgtggccgctgacggccggcatttacaatgtgatcagccaatacggaatccagtggaatgatctgatggcatttgccgttttatcggttctgcctgtcatcatcatttttatgctgcttcaaaagcagcttgttaaaggacttatcaatggatctatcaagtaaaaagaaagggtgttttcgatcatgaaattttcagacggctactggctgacgcgcgaaggatatcacatcaacacgccgaaagaagcctacgaccgaatgattgatcagcaatcattgaccgtgtacgggcctgtcaaagcggttcaaaagcgcggggacacgctcgacacccgcatgctcaccgtcagattttcgagtccccttgaagacatgatccgtgtgcaagtgttccattttcaaggggaaacgcctcggaaacccgactttcaactgcatacggcagatgttgaaccggtcatcaccgaacacgatgatgcgttgaccttccaaagcggcagcctgtgcgtcgaagtgagcaaaaacggttggggctaccaattttcacgtgatggacagagcctgaccgcaagcgaatcgaacagcctcgcctatatcacaagcgatgacgggcgcacctttatgagggaacagctcaacatcggcgtcggcgaattgctctacggccttggcgagcgttttacggcattcgtgaaaaacggccaaaccgtcgacatctggaatcaggacggcggaacaagcacagagcaggcatataaaaatgtgccgttctatttgtcaaacaaagggtacggtgtttttgtcaatcatcccgagctcgtctcgtatgaaatcggttctgaagtcgtatccaaagcgcagttttcggtcgaaggagaatcgctcgactattttgtcatcagcggcgccgaaccaaaggatgttttgaaacgctatgccgcgttaacgggaaaaccggcgcttcccccggcctggtctttcggcctctggctgtcaacatcgttcacaaccgactattccgaggagaccgtgacccgcttcatcgacgggatgaccgaacgcggcatcccgctcagcgtgtttcattttgactgcttctggatgaaagaatttgaatggtgcaatttcgaatgggatgaacgatattttaagcagcctgaagccatgctcagccgcctgaaagaaaagggcctgaaaatatgcgtctggatcaacccttacatcgcgcaaaaatcaaagctttttcaggaaggaaaggaaaacggctacttcttgaaaaacagccggggggatgtatggcagtgggaccggtggcaggccggaatggccatcgtcgacttcacaaatgaaaaagcgcgtgactggtattgttcaaagcttgaaagcctgctcgacatgggggtcgactgctttaagaccgatttcggagaacggattccgagtgacgctgtttactttgacggatcagatcccgaaagaatgcacaattattattcttatttatacaacaagaccgtatttgacttgttgaggcaaaagcgcggcgaacgggaagcggtcgtgtttgcaaggtctgcgacggccggcggccagcaatttcccgtacactggggcggggattgttttgccagctatgattcaatggctgaaagcctgcgcggcggcctgtcgctttctctttcaggcttcggcttctggagccatgatatcggcggatttgaaagcacggcaacagccgatttgtataagcgctggaccgcattcggcctcttgtcgacgcacagccgcctgcacgggagcgagtcataccgcgttccgtggctgtttgacgaagaagcggccgatgtcatgcggtattttgtcaaactgaagcacaggctgatgccttatttgtacgccgctgcacatgaagcgcacgctgaaggcattccgatgatgcgggcgatgctcctcgaatttcccggagacaacacctgccactggcttgacagacagtacatgctcggcggaaggctgctcgtcgctcccgtttttcaggaagacggcgctgtccgttattatttgccaaaaggcacgtggacacaccttttgacgggaaaagagacggaaggcggagaatggaaagaagaacggtacggctatatggggcttcccctgttcgtcagggaaaacacactgctgccgctggggcaggaatccgggcgacctgattatgattatctcgacgatgtgacgttctgcctctatcatttaaaagacggctgtacagccgaacagacgatttacaatgaaaagggcgaagcaatgacactcagagcttcacggcatcaaaatacgattgccgtgaaaacaacgggcgtccaaaagaactggaagctgctcctccgcggtctttctgtcacctctgttattaacggagctgcggaagcgcttcaggagggaacagcggttcagccaaaagaaaaagaacgggatgtcttcatttatttctaaaaaggagtgatcaggatgctgaaaacgggccgcatcatcatattgggcgcaatgtgcacgatcctttccgccgccggtttcgatccgccgcagcccgcagccgctaaaagccaggctgatgaatatgagtatccctttcaagatcccagtctccctgtacaaaaaagagtcagcgacttgctttcacggctgacccttgaggaaaaagtgtcactgatgcatcaatatcagcccgccgttccccggctgggcattcccgcttttaaaacgggcacagaagcgcttcacggcgtcgcctggctcggggaagcaaccgttttcccgcaggctttcgggctcgcgcacacatgggaccgctatttaatcaaacaaatcggctcggcggtcggtgatgaagtccgcggcttccaccaccttgatcccgcggcaaacggagtcaacgtctgggcgccggtcgtcgatctgctgcgtgatccaaggtggggaagaaatgaagaaggctattccgaagacccctttttaaccggggaaatagcaaccgcctatgcctccgggttaaggggcgatcatcccttctatttgaaaacagttccaaccttaaagcattttcttgcctataacaacgaaacagaccggggattcagctcctcaagcatcgatcccaggaacatgcacgagtattatttgaagcccttcgaaacagcaatttccaaaaaagctgcgtatggactgatgccggcctacaattctgtcaacgataaaccggccattttgagcccgctgctcgacagtacagtcaaacgtagatgggccggagacgatttcttcatcgtcagcgatgcctttgatccttccggaatcgtcaatgaccacaagtattatgacagccacgaaaaagcccatgcccacgccgtaaaagccggcattgacaactttacggatcagggggaaaatcccgagctgacgagaaacgccttaaccggtgccttaaagcaaggccttatttctgaaaaagacctcgatcaagccttggccaatacgttcagcatccgttttcgcacgggcgaatttgatccggacgaactcaatccgtacagccgcctgacagatgacgtcatcaacagtccaaagcatcagctgctggcgaaaaaagcggctgaaaaagccattgttttactgaaaaacgaccaggatctgcttcctttcaatgcccggaagaatgaaagcattgcagtcatcggcccgttcggaaatgcgctttacgaagattggtacagcggaacgatgccgtatcggaaaaccccgcttgacgaaatcgcggacaaaatcggcaaagaccgcgtctcctttgctgaaggtctggaacaaagcggcttcaaatccgcgccgaccggaaagtttgtaactgcaggccgggacggcaaacaaccgctcacagcagcggctgataagcttgagaaaagcacggcattcgatgcggcggattggggagaaagcatcttcaccctccgcgcccaagcgaacggcctctatgtctcgcttcaggatgacggccggctgatcgctgatcagaaacagccgaacggccggaccgttaaagaaacatttcagttcgaacagcagtctgacgggacatttgccatcaaaaatacggcaaacggcaaatatctcactgccggtaaagacggcacattaacagccgccgccgaaaagccggcaacagcagcggaaaagttttcaaagacgatcatcaagagcggtacggatgaagcggttcagctggcaaaatccgcggacaaagccatcgtgtttgtcggcaacaatccttacatcaacggccgggaaaccgaagaccggaaagatattacactccctccggcccaggaaaatctgctgaaagctgtttctaaagccaataccaatacggtgcttgtcgtaacgagcagctatccgtttgctctcaactgggcaaaagcgcacattcctgcgatcatatattccgctcacggaggccaggaggcgggaagcgcattggcggacattctctatggagatgtaaatccgggcggacggctgacgcaaacttggcacacctcagtcaaagaactgccggatatgatgaattacgatatcatcaaagggaaaagaacctataaatatttcgtaggcaagccgctgtttccgttcggccacgggttatcctatacagcgtttcgctacagcgatttaagcctttcctctgacagcatcaaaaaagacggatctgtcacgattcgcgtcaacgtcaccaatacaggcggaagaaaaggagatgaagtcgttcagctctatacctctcccctgtttaaaacacgggttaaacagccgaacctggacctgaaagattttcagcgggttgaactggcaccgaaagaaacgaaaaccgtgacattcaagctgaaacagacagaccttgccttttgggatgtgacgagagaaacatttgccgttgaaagaggcccttacagaatatccgtcggcagctcggcggcggacatccgcaagacaaagcggatcttcgtccaaggcgaaacaattcgggaacggaacttgcgccgaaagacaaacgctgaagactacgacgactacaaaggcgtgctcatcaccgaagaatccaaatacggcggcgatgcggtaaaaagcagtacaacaaacgcgtggatcgcctaccatgatgtccgcttcaaaggcgaaaaaaggatagaagcaaaggttgcaagcagcggcgccggcgaaatcggcatcttcctcgaccatcctcaaaaaggaaagcaaatcggttcgttaaaagtgcctgacacatccggattgcaaaactggaaaacggtaaaagcttccgtccgaaaatcgacaggcacccaccgcgtcttttttgtcttcaaagggaaagttgcaatcgattcgtttcaatttgaaagataaaccggcaaacaagaaattttttaaagccatgcagcttgatctgcatggcttttaccgtttttcagcaattttagcgctttacaatttaggaatgatatattagaattcaatcaaaagttgcattaggtaaaaaaaatgtctttaggcaataaaaaattgccgaaacaaaaatattgtatgcaggttaactttcatatagacatagaaaggggttaatgaacgctatgaaacccgcaattaccgtaaaagatttatatgtttcttatcacggcgcagaagcgctccgcaatattaatttctcactcgatcaaggaatgatggcgggcattatcggaccgaacggcgcaggaaaatcaacgctgttaaaatccatgctccaattgattccaaaagataaaggcgacgtccgtctgctgggaaaaccgctcaaagatgtacgcaagcaaatcgcctatgttccgcagcgaaatgatatggattggacgttcccgatcaatgtcctcgacaccgtcatcctcggcacgtatcctgaactcggccttttcagacgtccgaaaaaacgcgataaagactgggcgtatcactgtcttgagaaagtcgggatggctgcatatgccaagcgtcagatcggcgaactgtcaggcggacagcagcagcgcgtttttctcgccagggcgctcgcccaaaaagcagagctgttctgtcttgacgaaccgttcgtcggtattgatgtgacaagtgaagaaatgatcgtcagcatcttaaaagaacttcgtgatgaaggaaagaccgttcttgtcgtccatcacgatttgagcaaagcggacagctacttcaatgaattaattttgctgaacaaagagctgattcaaaaaggccctgtctccgacatcctcaatcccgacgtgatgatgaaagcctacgaatctcagcttccgttcctgcaatcgaaaagaggtgcgatctgatggagtttatccatggtttgatggaatattcgtttctgcaaaaatcgctgttcacctcgattatggtgggcatcatttgcggcgtcatcggctgctttatcattctcaggggaatggcgctgatgggagatgcgatttcacacgcggttcttcccggcgtcgccatctcttatatgctcggcgtcaattttttcttcggcgccgtctttacgggcatcctgacggctctcggaatcggctatgtcagccaaaacagccggattaaaaacgattcggccatcggcatcgtatttacggcctttttcgccgtcggaatcatattgatcacgcttgtcaaaagctcaagcgatctgtaccatatcttattcggaaatgtgctggccgttcgttcatcagacatgtggatcacgctcgtcatcggagtcattattcttaccgctgtctttttattttacaaagagctgctcatcacctctttcgacccgacgatggcggctgtctacggcttgccgaaccggctgatccactactttttaatgacgcttttaacaatggtcacggtcgcatcgcttcagaccgtcggcatcatcctcgtcgtcgcgatgctgatcacgcctgccgcaaccgcttatctattgacggaccggctgtgggtgatgatctatttgtccgctttcctcggcgctttgtcagcggtcatcggccttggattaagctatacgtacaacctctcctcaggagcggcaatcgtgctcgtggctacgattttgttcggactttcctttacgttttcaccgaaacaaggcgtgctttggagagctgtgaaatcaagaagaaaacgggcagcgcttcaacaataaccgcaaaataaagggggaaaacaaaacatgaaatggaagcaaacattagcaattgcggcggcattgattctgattctcgccgccggctgctcctcgaaaagcagcagcgaagaaaacggaaagctgaaggtcgtcaccacctactccattctttatgacatcgtcaaacaagtcggaggggatcacatcgatttatacagcattgtacctgtcggaacagacccgcatgaatacgatccgcttcctaaagacgtgcaaaaaacgacggacgccgatgtcgtcttttacaacggattgaatttggagacagggaacggctggtttaacaagctgctggaaacagctgaaaaagacggtgatgacgcccctgtctacaagctgagcaaaggggtcaagccaaagcatctcaccgctaagggaaaagaaacggaagaagatccccatgcatggctcgacattgaaaacgggattcaatatgcaaagaacgcaagagacgcgctgatcaaaaacgatcccgaccataaagaagactacgagaaaaacgcggaagcctatatcggcaagctgcaaaagcttcatgatgaagcggtgaaccgctttaaagatataccgaaagagcgccgcgtccttgtgacaagcgaaggggcttttaaatatttcgcttcggcctacggcgtcgacgcgcagtatatttgggaaatcaacaccgaaaatgaaggaactcccggtcagatgaaaaaaatcgtcgacacagtgaagaaaaaggacgtcccggccttattcgtggagacaagcgttgacccgcggagcatggaaagcctttcagccgaaacgggcgtgccgattaaagcaaaagtcttcaccgattcgatcggaaagcccggtgaagcgggagattcctattataagatgatgaaagaaaaccttgaccggatccatcaaggcctcgccgaataaccaatgaactgctgtacaggatgtacagcagtttttttcttatgtttttccgattttaaagcagggtacaacgaagggaaaacgaggaaaaaggagtgtgtttcgtgaaatctggatatgaggaatgcatcaaagcctgccgagaatgtcttgaagcctgcaaccactgctttgacaaatgtctgatggaagaagaggctgggatgatggccgaatgcatccgtcttgaccgggaatgcgcggagatgtgcggttacgcaattcaagccatgacgcgcaacagcccgtatgccgaagatatttgccagctttgcgcaaaggtttgcgaagcttgcggcaatgaatgcagccagcacaagcatgaccactgccaattttgcgctgaaagctgctttgcatgcgcggaagcgtgcagaaaaatggcttcttaacttgaaacatccggccctcgagccggatattcttatgtaggaaatgtttattttttctccttccccctttctaaactgatacaatatgactataaaagggggttttatcatgaaagacagcgtgtttcaaatgacttctgacacatatcaatctctcagcgattcagaacggcatttgctcgagtacatttatcagcacttagacgtcatcgccactttatcgattgtaaaattaagcgaggatgcaaatgtttcaacagccacgattgtcaggttaatgaaaaaactcggatatgacggctacacttcttttaagtatgcattaaaagaaaaacaccacctcggacacgctccgctgatggatgatatcgacagccaaattaaacaggccgtgctaaagaatgaaagagaagttctggatacgattaagatgcttgatatcgggttgatcgaagatgccattcaaaaaatcagcaatgccgaaaaagtttacatcttcgcaagaggattgtctgaaatgattggaaccgagatgacgatcaagcttcagctgctcggcaaaaactgcgagatgcacagcgacccgaatattatcagaggaaagtcaaaaacactggccaaaaaagacctcggcctttttgtttccttgaacggcgagacagaagagcttgttgaagccgctcaaaatttcaaattgcaagccatttccaccattacattaacgacaaggatcgattcgcgtcttgcgaaattatcagagatcgtactggtcgggtttaaaggggaacaatcattttttcccgattatgaagtccgctctcgcctccctctgcaagtcctctcccgcatcatgctggactcatatgtcatccgcaccgctcatagctgaaaacctttacacaacctgtaaacatcccccctttcatctgtgacataatgtctgtgaagccacatataaaggggggatacagcatgatctatacatgcacgatgaacaccgcagtcgacttattcgttgaaaccgacgagctgcttcccgatgttgtcaaccgtactaaagatgaagattatcagccaaacggaaaaggcgtcaatatttcatttatgctcaagcgccttggtcttgacaataccgcgcttggctttacaggcggattcaccgggcgttttattgaaaatgaactgctgaatgaaaaaatcgtcacagactttgtcgaagtggaaggcatctcacggatcaatatttttatcaattcaacccgggaattcaagattgtaaacaaaggaccgctcatatctgaagcccgaaaacaggagctgatcaacaaaatccgtcaaatcccgccgggccgcttcttatttatttcaggcagtcttccgagaggagtccctgatgacatgtacctttcgctttccgagattgccgccgaaaacaaactgaaattgatcttggatatcagttctcccgtcctattagattgtctttcataccatccttacctgattaagccgaatgaacaggagcttgccgcatttttcagccggaagaaagcgctgtccgaagaagaaatcatccattgcggaaaggaacttctcgaccgcggcgctgaaagggttctcatctcccgcggcaaagacggagccctttatttggaccgccaaagaacattaaaagcgaccgccgctaaaggcaaagttgtcaatacagcatgtgccggcgatgccatgcttgccgtattcgtcggaaaacaggagctcggctgttccgttcctgaagcactcaggcacgcctctgccgccggttccttgacggcattctcgaaaggactcggtgatgtgtccaaactcgatcaaacagcttcacaaattcaaatcactcatttataaagggggttttcttatgaaaaagttcaaaatcatcgcggcaaccggctgtccaacagggattgcccatacatttatggctgaagaggccttaaaacaggctgccgccaaactgggtgtggaaatcaaagtcgaaacacacgggcaaatcggcgttcaaaacgaactatcgccagaggacattaaacaagccgacggggtcattgtcgcggcagacaaagatgtaggcgcagagcgttttgcaggcaaacgtgtccttgacgtcccggttgcgcggggcatccgggatgcggaatctttaattcggacgctgatgaacggcgaagcgccgatttaccgcggacaaactgcggcaaaaacagaggatgaaccaaaaacaggcgaatccgcttccatcggccgtaaaatatataaacatttgatgaacggggtttcccacatgctcccatttgtcgtcggcggaggggttttgattgcactttcctttttattcggcatccattcagcggatcctgaacatccaagctacaacgcttttgccgaattgctgaataaaacgggcgcattcggattccagctgatggttccgattttatccgcctatatcgccgattcaatggcaaaacgccccggcctgattgtcggttttatcggcggcatgatcgccagcacgggcggagcgggttttctgggcggcatcgtatccggttttttggcgggactgatcatttacggcctctcgcatgcacttaaaaaaatgcctcagtcacttgaaggactaaaagcaatttttctttatccggttatcggcatttttctgatcggtgcggtcatgtttttcctcgtcgaaccgatgacggccattaatgaggggatgaagggctttttagccgactttcaaggggcgaacccaatcattctcggcttgatcatcggctgtatgagcgcatttgacatgggcggcccggtcaataaagccgcttatgtcaccggtactgctcttctcgctgaagggaaccaatatttcatggcaggcgtctccgccgcgtgcatcacaccgccgctcgttattgcgtttgccacattgcttttccgcaaatatttcagccagcaggaccgaaatgcaggacttgtcaattttattctcggcgccactcatattactgaaggcgctatcccgttcgccgcaaagaaaccaatccctgtcattccgattttgatgatcggctcttcggtttcggcaatattaacatattcattcgcagttcaagtacctgccccgcacggcggattccttgtacttcccgttgtaacaggagcctttcaatgggtgctgtcgattatcatcggatcgcttatcggcgccttcttatacggcttttaccaaaaacggacatatgaaaaagagaaaggctgatcaaacatgaaaacagcagctttaatcaaaaaagagcacatctatctacaagaaacgctatcttcccaagcggaagcttttgaccggctggctcagatcgcatatgaatcaggagcagccaaaacaaaacaagcggtcattgacggattggcgcaaagagaggctgaaagcacgaccggctttatcgacggcttcgccattccccatgcaaaactgaaggacatcacagaagcaactgtcatcatcattcaaaacaaggcaggaatcgaatggaacgcgcttgatcagacgcctgtcacgttcatcattgcattattgatacccgatgccgaggcaggcagcacacatctcaatctattatcatcggtgtctcgcatgcttgttcacgaagatgcgaggcagcagctgcttgaagcctcgagtcctgacgacattctgagcaccttctcaagctatttatcttaattttgatcagaaagaaggaatcgatatgctgacaaatacgaaaaaaatgctgctggacgcacaggcaaacggctatgcggtgccggcctttaacattcataaccttgaaaccgtgcaggccgtgacagaagcggctgaagccttaaggtcccccgtgattcttgcggctactccaggaaccttcagctatgcagggcgcgactatattcaagccattgcagaaacggccgcggcgcgctgctcgatcccggtcgccctccatctagatcatcatgaagaaattgatgatattcgcgagtctttatcattggggacgaaatctgtcatgattgatgcttcgcaccatccatttgccgagaataccgcaattacggcgagtgtcgttcaatatgcccggcaaaaagatgccactgtagaagccgagcttggaaggctcggcggacaggaagacgatttgatcgtggatgaagccgacgcttattataccgatccggatgcagcaaaagagttcgtcgagaaaaccggaatcgattcgctggcggtggcaatcggtacagcccacggtctttactcaaaagagcccaatatcgattttgagaggctggccgcgattcaaaaacgggtttcagtcccgctcgtcctgcacggcgcctcaggaatttcagagcaagatgttagaaagtgcatcaagctaggctgtgcaaaagtaaatatcgcgactgaattaaaaattcctttttcagataaactgcgccgatatttgcatgaacacgccgatgcaagcgatccaagaaaatatatggcccccgccaaagaagccatgaaaaaaatcgtccaagaaaagattttgatgtgcatgagcaatgacagatactaatacaaaaagccggatgttctttaacatccggctttctcagcaattcatttgacatgctcttctaaagcatgaccgtcatggggcttttcatcgggtatcggttcccgaccggccaatatgctgtatacaagcatgacaattcctacataaacaaccgctgaaaccgtccaaacgagcactgtcttatccttcaagacggattcctccaatcaagcttcaccttttgcagcctgagtgcattcagaacgactgagaccgaactgaacgccatcgcggcacctgcgatccacggagccaaaagcccgacagccgcgaacggaatgccgatgctgttgtaggcaaacgcccagaaaagattttgtttaatgtttttgatggtcaatctgctcatgaggatcgcatcggcgatgctgtttaaatcgccgcggatcaaggtgacgtcggcggcttccatggcgacgtcagtccctgttccgatcgccatacctgtatcggccgccgccaatgccggcgcatcgttgatgccgtcgccgaccatcgcgacttttttgccttttgcctggattttcttcacctcatccgcttttccttccggcagaacttcggcgatgacgtggtgaatgccggcttcagcagcaatcgcttctgccgtccgccgattgtccccggtgatcatgacgacttccagccccatatcatgcagccttttcaccgctgccttcgacgtgtctttaatcgtatcggcgacggcgatcagcccggcaaaccgaccgtcgacggcggcaagcatcgccgtctttccttgtgtttcgagctcttccatttcgccgttcgcatcttgaatgtcaatatcacggttttccatcagacgtcttgtaccgatcaaaatccgcttttcattgactgcggcttcgataccatagccgggtatcgcttcaaagctgtctgctgaggcgggttctatccctttctctttgatgccttcgacaatggcttcagcaagcgggtgttcagagcttttttctgcagcaccgataagcttgagaaacgatgtttcatcgatccatggttcagggcgcacatctgtcagctgaggcttcccatttgtgaccgtccccgtcttgtcaagcacgatcgtctccaagcggtgagccgtctccaaatgttcgccgcctttgaataagattccgaattcagccgcgcggccagatccggccatgatcgatgtcggcgttgccaagccgagcgcacacggacatgcgatcacaagcaccgcaatcagcttctccagcgccgtgccgaattcgccggggctgaccgccaaataccagatgaaaaatgtgatggccgcgatcgccacgacaatcggcacaaaaaccccggaaatccggtctgcgagccgttgaatcggcgcctttgaaccttgcgcctcttccacaacttttataatctgcgccagcgcagtatctttgcctactttttctgctctgacttttaaaaatccatttttattgattgtagcgccgataaccggatctccaaccgttttgtcaacagggatgctttcaccggtgatcatcgattcatccagcgctgaacgaccttcgacaatctccccgtctgccggtactttttcaccgggcttcacatacatgatgtcgcctgccaaaacgttttcaatcggcacggtcatctcttcgccgttcctgacgacggtcgctgtctttgcctgcagccccatcagctttttgatcgcttcggatgaacgccctttcgctttcgcttcaaacagctttcctaaaatgatcaaagttaagaggatggcgcttgtttcatagtaaaggccgtccggatgccggtttgtaccgaggctttcaatgcttaaatacaagctgtagaaataggcggcagacgtgccgagagcgaccagcacatccatgttggcacttttgttccgcagcgctttataagccccagtgtaaaactgcttcccgacgataaactgaaccggtgtggccaacgcgaactgaacccagggatccatgaacatccccggcagccatataaatgacgtgaatttgaaatggctgaccattgcccagagcagcggaaaagacaaaatggctgaaaaaataaatttgccggtttgacgctgaatatctttttctctttgttccgcccgaccgtccgcagttcggtcttttttcagctcgagcttgtagccgagcttttcaacggcttcgatcatctcctccggcgaaaccgcgccagcatgatagtcgactgtcgcagtctcaatggcaaagttgacggcggcgcttttgacgccagacagcttgttgaggcgcttttcaacccggttggcgcaagccgcacacgtcatgccggaaaccgcaaattcggctttttccgcaggaacttgatagccgagcgattcgactttctcagccagctgtccgacttcgatttgccccggatcataaacgatttttgatttttccagcgccaagttcacatttgcgtcctgaacgccgtcaagccttttcaaccctttctcgatccgcgccgcacaggcggcgcaggtcatgccagagatttggagggtggcttctttttgtccgtccatatccttcactccttatataccccttgtaggtatacatcagcctgcaacatcatacccctggtcttcgatcgtatcgatgatctccttcagcgagactttgcctgaatcaaacgatacttcgactttgccctcgtttaaattcactttgacagactccactccgccaagctttccgacgtttccttctactgcctgaacacagtggttgcaagacatgccttcgactttcagtgttttttgttccatattgaaaacctcctgtggtttgatgatattgatcggttttatattaccatacccctgtagggtatttcaagaaaacgattttctcttttttcgttcatgattttgaaaaccgtttaaacacatcaagcagttcctcgatggcttcttctccctcaccgcttttaatcgcgtttgcgacgcaatggtgggtatgatcctcaagcaggctgaaagcaaccttttgcatcgcggcttgcacagctgagatttgaacgagaatatcgacgcagtagcggtcattttcaatcatcttttgaatgcctctgacctgtccttcaatccgctttaagcggtttgtgatttgttcttttcctttagagcttttgggatttaacgcgtgttcatgatgatctgccatcggaacacctctctttcctttatattttgtccaagatccccattggtaccattataaaatgcgaagcggaacatgtctaaaaaaagagacaaccccgaactgctgcggggtcatccctgcatattatttgtttaacgctttaaaaaattctctcataaactccggcagattggaccagtcatgacctgagaccaggttggcgtccacatgaagcttctcctcgacataagtcgcgcccgcggcttcgacttccggtttgcaggcgatgtaagccgtcagctcccggcctttcagatgttctctcaggcttgtgaaaatcaggctcgcatgacaaatcgcgccgaccggtttattttcctcaaagaaatgagcaacgattttcagcagggaatcgtacatccggataaattccggtgcgcgtccgccaggaatgatgatgccgtcgtattcggacgggtcaatctcatcaaatgaagcatgcgcgtcaattaaatagcccggcttttcggtgtatgtatcccaatccaggaagtcatgaacaaccgtatgaatctttttctttttcggtgcggcaatcgtcgtttcatagccctcttcaagacagcggtaataagggtaatacacttccagcgcttcaactgcatcgcccgttacgattaaaatctttttcgccatcaaaaacatctcctttccttttttactcttctattttatcccatttgcgcctgtttttaaaatcaagtgcttgagaagttttgtttcagccgacgatcgtgatgttctctgttatgtctttcaagcgggcaagatttgctttgtcaattcctgaatctgtgatgaccctgtatcggtcatgaaggcggtcgatttgcgagaaagcacgggttccgaatttgctgctgtccgccatcaaaatcgtttcgtccgcaatttcgatcattcgttttttcaacagcgcctgcatttcgtttgaatcgctcaagccgctcgcagggtcgacgcctttgcaagacagaaatgttttgttgacgtgatacatgtcaagggagcgctcagccaaagggccgacatatgacatcgattgcggcagcagcatcccgccggttgaaatgaccgtcaccttttcttttttgctgagttcaatcgcgactctgactgaattcgtaatgacggtcagcgggatgttttcaagcgcttttgccatgtaccatgccgtcgtgcttgcatcaagaataatccgttccccgcttttcacatgcttgacggcttcaaatgcaatcatctttttttcgtttacgtttgtaatttcgcgctcgcgaaaatgcacctctctttcttcagtctgcacgctgactgcgccgccatggcttcttttcagcttattttccttctcaagcttttccaaatcgcgcctgatcgtttcttccgtgacggaaaaaagctcgctcagttctgtgacgcgtacgctcgagcgcagattgacaagctcgacgattttttggtgtctttcagctacaagcatccgtttacttccttccttttttggtaaaagtcactgttacattcatgatagcgcatcggctccgatacaggaaaggttttcagcgggaagcggcgccgagaatctgacttgtatagcggcggtatgcccgctcccacgcttctgtatcttccggtacatacgttttttgaggaaaggaagccttgatcgctttccgggcgctctgaatatcccaaaacatgtcgagcgcgacggcctgtacggcaatgttgccgatggcgcttgcctctgacggtccagcccatacatttctggacagtacattcgccgtgtattggcagagcagttcatttcgaatccctccgcccgccatgtgaagtccgtcatattcttttcctgtcaaggtttcaatccgttcaaaggtgaaccggtatttaaacgcaaggctttccagcacgcagcggatgatctgtccgggcgtttccggcacgtgctgccctgctgcacggcagtactctctgatcgcctcaggcatatggacgggattgagaaacaccgggtcatccgggtcaaccgccgacctgaatgcttctgactgtccggcaagtttgacaagctcggcgctcgaatagctgatcccatctttttcccaatccgcctgacagcgctggaacagccacaatcccataatgttttttaaaaaacggaatgtgccgccggcaccgccctcatttgtaaaattccaatcgagcgcctgttttgtcatcagcggagcgtcaagttcggttccgatcagcgaccaggtgccgcaaatcaaatatgcaaagtcatccgtttcagcggggatgccgacaactgcagaagccgtgtcatgttcgccgacggcaatcaccggtacggcgggcacagacaattcgccgcacactgattgcgacagcctccccgcttcgcttccgggctttgctatatcttttggaaaaatcttggccgggatccccagaaggctgatgagctcccaatcccagtcagacgttttcgggttgaacagctgggttgtcgtcgcatttgtaaattcgctttttttctcgcccgttaaaaaatagcgcagcaaatcaggaatcattaatagtgtgtccgcgtaatccaacagcggagaattcgcttttttcagcgcccggagctgaaagatggtgttgaacggcaaaagctgaataccggttctggaaaacagctcttcttttccgatttcattcaacacctccgtcattattccgtccgtgtaagggtcgcggtaatgataagggttccccatcagctctccgttccgatcgagaaaaccgacgtcaaccgcccatgaatcgattccgatgcagctgattcgtccacagccgtttttcgcctttaaaatgccctgtttaatttcatgataaagcctgagaatgtcccaataaaggtgttttcccgcctgaacgggctgatttggaaaacggtgaatttcctccgctttgatcagaccgccgtccacatgacctgcataagctctgccgctcgacgcaccaagatcaaaggcgagaatcgtcaccagcttgcaccgcctttcccgcgtgccaggattttttccgcatatccgctttccgcataagccttgagcggatcaggcggaacgttcatttcctcccgcacggcgcagaggagcggcttgacgtcgatttcaaatgcctcgcggatcgcagcctctgcggcaagcacgtcatgatcttcctgcgctttcttcacttcatcgaagttgatcaaaagcgcttttgcaaattgagtctgcacattcatgaccgagcgcagcacagcgggtattttcggttcaagattatggcattgatcaagcatatacgaaatatgttcggccgtcttccggacgttcgggtcagaatcacggcaggcgtccaaaatttgagaaaaaatgagaaacagttcgtacgggttgtgagcgcccgcgatcaaatcgtcatcagcgtatttgcggctgttgaaatgaaagcctccgagacgtttttcgtcaagcaaataagcgacaatgtgctcgatgttcgtcccctgggcatggtggccggtgtcgacgagcacctcagccttcgggccgagcttttgcgccaaattgtaagccatgccccaatccgccagatcggtatgataaaaagccggctcaaaaaatttgtattcaatcaagagccgcatatcatcgtcaagagcttcgtaaacttcagccagacactcatacatccagtttttccgttttctgatgtcgccctgaccgggatagttggttccgtcggcaagccagaggctgatttccttggagcctgtttgttttgcaatatcgacgcattcgagcaattgctcagtcgctttttggcgaatggccgctttcacgtttgtgacgctgccgaatttgtagtcatcgtcctggaacaagttcggattcacggcgccgatagcaaggccaagctgctcggcgtgcgctttcagctttccgtaatcatcaactcgatcccaaggaatatggatggcgacggaaggacaaattccggttaatttgtgaacgactgatgcatcttccattttttcaaacggatctcttggcacaccctcttgctgaaacactttgaagcgcgtgcccgagtccccgtatccccatgaaggcgtctcgattttaagcgctttcaatttttcctttgcttcagaaaggctgattcccctgtctttctgctgttcttcaaataaagcgtaggcccggtcattcatcatgtacgcccatcccccttgtttttaacggatatgccatggttgacattaacgcaagttccggctgggtcgtgtccagccggctgtactggacgatcacaggtacatcgcttgcgatctcgatcgcataaggaacattttcaggaatgcgttctcctgatcggtgcaaagaacttgtgcggatatgcttcgttctcttgccatgaaccgtctcggaaatgccttcgagcggcggacggtcttcgaagtatacggtgatcgcaaggtttgcgttttcttcatggcaatttaaaacacaaatggcttcatggctcgtcaagcttccggaactttccggaggaataaaaccgtccggtatgatccaatgggtctcgcccttcatctcccttttccccctttgtattctgaaagggcggccgaagccgctccttatcaattaccttgaaaatgcggccggcactcccccgtcaaccgtcagcatgcatcccgtcgtttttgccgttttttctgaagcgaaataagcgatcgcctcggcaatgtcggcgggataaatgttgacggaaagagccgtacgtttgcggtaatgctcttcaagccggtcgggttcaatcccgtaggcggcggctctttcttcgcgccatttggagtcccagatggccgacccttgaagcaccgcatccggaagaactgaattcgcacggattccgtacggtccgccttcagccgcgatgcatctcgccaaatgaacctcaagcgcttttgcagagctgtatgctgatgcgtttttgcctgcataaacggaatttttcgaaccgacaaacaccatgctgccgcctgaaccttgttttttcatttgcttaaaagcttctctggccacgaggaaatatcctgttccgagtacattcatattcaggttccattcttcgagcgtcgtttcatcaagcgggcttgatgtcgcaaggcccgcattgttgacaaggatgtcaatcccgccgtatttgagggcgatttcctcgaaggccgtctgaacctcctcttctttcgtcacatccatgcggacggcgtaagctcgttctgcaccgtattgatcattaatctcggccgctgttttttctgcgccttcaatattaatgtcagcgaccacaacatgcgcgccttctagagcaaggcggcggcaggcctcgctgccgattccgcccgctccccccgtcacaaatgcgatcttgcgcgaaaattcggcttccggcggagcaagcgttaatttataaagctcaagcggccaatattcaacattgtaggattcttcctcattgagagatacaaagtttccaaggacttccgttcccttcatgacggcaatcgcccggcggtataaatctcggctgaccttcgccatcgccaggcttttccctgctgtcaccatgccgattcccgggatcagcatcacgcgaggcgccggttcaaacatctcgtctccttcgtgccggtttcgttgaaaataggcggcatacgactctttaaatccagcaatctcggttttgatccggtcgaccagcgcttctgtgtcctgttcagcgggattccacggaatataggcaggcacccgctttgtatgaacgaggtgatccggacaagcggcgccgacctgtgaaagcgacggtgcgcgcctgctgttcgcgaattcgagcacatcgtcagcatcgcaccaggtgacgagcatgcgtttttccccgctgacagcgccgcggatgaccggcaagatatcggctaaaatccgtttccgctcctccggtgcaagcggctcgaccatctgtccgccaaacggctgatgatcttccgaacggcttttaatatatgcttccgcttcgcgaatcacggcaatcgtctgatcatagctttctttcgacgtttccccccaagtgacgagcccgtgcttctccattaaaacaagctctgcattcgggttgtttttcacaccttctgctatcatcttcgataaagcaaagcccggtctgacataaggcacccatacaaatcggctgccgtatatctcctctgcgatctcttttccattatcgcagcagcagatgctgatgattgcatcggggtgggtgtgatcgacatgcggaaacggcaaaaaagcatgaagaagcgtttcgatcgacggccgcggatgctttccgtccatcatgcaatgggacaaatatgccgtcatttcttcatcggtcatgctgctccgttccatcagcggacgaatatcatccagcctcagtccggtaaattggcccgctgacatcgtcgccaagtccgagccgctgcctttcacccacatcacctcgatgtccctgcctctgaaatccttttctgtcgttttcatcgatgtgtttcccccgccccagttgcagaccgaacggtcagcgccgatcagattggaacggtagacgagctcggcaagacccggacgcagcgatgcagcctcagactctgaccataaatatttcaccatgcgtatcactccgtttttgtttgtttatttttgaatatgtttgttttaagagtaacatattttgattttctttgtaagcgcttttttccgaaaccattttaggacagaatctcttcaatcagtcgataaataaaaaacgccaacagcaggcggccgtcggggttaagaatgtaggaatgtttaatctttgattttaaaataaaatgtcaggttttaagaaagcgctggcatcttgttgccggcgctttttgtgccgctgacataccgtttgggggaacatattgatgcgcaaaaaacggttgaaattcgtcttttgatcttttaatatataaactcatgttttttaaaaggaggggtcaggatgaaaaaaacactgcacgctccagtcaaactgatcatcgcaatttttatgatttgtacattttccatcggctttacagagtacgtcgttatgggtatattgacttccatttcaaaggatctctctgttccgatttcgtctaccggcctattggtaacggcatatgcgggaagcgtctgtctgacggggccgatcgtcaccatattttcggtaaaaatgccgcgcaaaccggtattgatcggcttgatgagtgtgtttgtactgtcgaatgcgctcagtttcctggcgccgaacttcaccgttttgttggtctcaagaatcctatccgcatccattcatggtgcattttttgcaacgacaatggtgttcgtcagcgaaatggcaccgcccgaaaaacgggccgccgctgccgcttcaatgaacggcggcttgaccatcgccctgatgctcggcgtcccgtttggttcttatttaggcgatcttttcaactggcggatcgtttttctgatgatcgcatgcctcggattgatcggcctcgccggcatttggctgacggtgccgcacagaaaaccgaaagttgtccctaaattgatccatgaatgggatgtgtttaaaaataaacaagtccttttttcttttgctatcacgatctttggctattcgggcgtattcatcgcctacacgtttattgaaccgatgctgcggcattctgccggtttgggcagtctcggcattacagccgcccttttcgcctacgggtttggcggggtcgtcggcaatttctacgccggaaaggtgccgtttcacctgttaacccgctccatgatcggggtgatgatcgcgctcatggcgatccttgcggcctttccttttgtcagcggacatcctgccggcgccatcatcgtgacgtttttattcggagccggcgcgttcggaacggtgccccttttgcaaacaaaggtcgtggctgcgtctgaacacggaacaacgatcgccacctccgtcagcatcgctgcatttaacttggccaacgcgctcggggcttggatcggcggactcattcttaatgcatcagagtcctacacataccttgccacaggcggtgcgcttatgaccatgtgcgggctgacgcttacgatgttcgcctatatgtctgagaaaagacaagtgaaagaagacatgtggggaacggacctgtaatcaaaaagctgcccggcttaagacctggcagcttttttgtttggttcttgcagcgtctttgtgtgagctgctttccgcatgaccgcggtcatcaaaagggcggctgcggcataaacgataccgaaacagccgaaaacgaaaacagaagatgacatccccaataacatgcctgatataacaggaccgcaggccattcccgtatacctgataaaattaaacatgcccatcgcactgccgcggttctcctcaaattcattcgccatcatcgtagagaagagcggcggaatcagccccatcgtaacgccgaaaagaaccagagccgccgacatggcgaaaagcgaaaacaaatgggaaaaggcaaaacagacgacgctccctgcggcggtcagattgccgatcaaaaacaggcgtctgagcgataatctcttttgtatccacttaaacagcacgctgccggcaatcgtgctgaccgctatcggcaaatacagcaagccgacgatctgcagatcaaggtgatagtgatcggtcagcaaaatcggcaaatacacgatcattgaaaaataaataaagaaaataaggtagcttaatattaaaacggcattgcccgccctgtttttgaatatgtccttataatgcgacagcaggctgcccgcgctgagattggtctttttctccgaatggctgcgcggaaagcaaaacaaattgccgaaaagcaaaagaacagacaatactgtcaaaaaccaaaaaatacccggataattatagcgctccccgataaaaccgccgagaataggcgccgctgccggtgcaagggaaagcagcatttgataagttcccatcgcactgccccgcttcgttcccttaaacagagatccgattgtggttgccgcaattaatggaagcgcagcagtccccaaagcctgcagcaccctgaaaaaaagaaacaggccaaagtcccgggaggctgcgcagccgattgtggcgatgaccgttacgatcatgctcgccatcattacaaatctcgctcctttaaaatcaacaatcgagccgacaatgatctgcatcgcagctgtaatgaagatgaacagcgagacggacaggtttaccatcgaaacagaaacgtgaaacgagtctctgattaaaggaatgataggtgaataaatattttgattcaacgatgcgaaaaaagcgctgatacacacaaaatacataatgaaagaagcatttgatttcattggtctcatttcaaaccgcctgccttgtttttgtttattcgttaacaatttatctaatatcgtttactggttaacaatattaattgtagatgacccctttatcattgtcaatgaacatttcttattgcagctttaaagttttttacatattttttacttatcgagttccttgactcaaaaagcgccttaaataaaggtttttatactttcaattctgattacaattcctcagattcacaaaaaaagttacgaatattttcatattttgaatttgaattgtgttgacagttggaaaagatagggataaaatgactattgtttactagtaaacttttatgctgtaacttgcctgattttgagtacaaacccttgccctgctttaacaattgaacaaatgccacaccccttcatcatgacccgcatcatcgctgtattcttctcgattcatcacgaagtgagaccagcctattcccagctcgataagccgcacgtatccatcattgattgcaaatgaagtcactctatgtccgttaaggaggaaatcaatgacagagcttataatggagagcaaacaccagctattcaaaaccgaaactcttacccaaaactgcaatgaaatattaaaacgcagacgccatgttctcgtcggcatcagcccgtttaacagccgattttccgaagattatattcatcggcttatcgcctgggccgtccgtgagtttcagagtgtatccgtgcttttggcgggaaaggaagctgccaaccttctcgaagcgctcggcaccccacatgggaaggccgaacggaaagtcaggaaagaagtctcgcggaaccggagattcgctgaaaaggcgttggaagcgcatggcggaaatcccgaggacatccataccttttccgatttcgcgaaccagaccgcataccggaatttgcggatggaagtcgaagctgcctttttcgaccagacgcattttcgcaatgcctgcctggagatgtcgcatgcggctatcctcggacgggcccggggcactcggatggatgtcgtggaagtcagcgcagacatgctggagctggctgttgaatacgtcatcgctgaacttccgtttttcatcgccgcccctgatattttaggcgtcgaagagacgcttcttgcttatcaccggccatggaagctcggcgaacagatctcccgtaatgaatttgccgtcaaaatgcggccgaatcaaggatatctcatggtttccgaagcggacgaaagggtggaatctaaaagcatgcaggaggaacgagtatgaatcaatcgctaaaaacattcagcgtgttgtcagaacaatatcacgaaaatccgtatcagtatttctcataccttcgggaatctgatcccgtccattatgaagaatcgctggacagctattttatcagccgctaccaggatgtgcgccgcgtgctccagaatcaggacgtctttacaacgaaatcgcttgccaaacgggccgagcccgtcatgcgcggacctgtgctcgcccaaatgaaaggcaaagagcacacggcaaaaaggagaatcgttctgcgccgctttatcggggaatcccttgatcacctcacaccgctcatcaaagaaaatgcacaaaggcttttggccccgcacgtggagaaagggcggatcgaccttgtcaatgatttcggcaaaacattcgccgtttgcgtgacgatggacattttaggtttggacaagaacgaccaccaaacggtgagaaactggcacagcggcgtcgccgatttcattaccagtttgaatcaggcgcctgaggaccgggagcattccctcaaatgcagtgaacagctcgctgagtatttgaatccgattatcgaggaaaggcgcaaaaatcccggacatgatttaatatccatcctttgcacttccgaatacgagggagtggcgatgtctgaccgggacatacgcgcgctgattctcaatatattgcttgccgccacagaaccggcggacaagacgctcgcattaatgatttatcatttgcttcatcatcccgatcagatgaatgatgtgctggaagaccgcacgcttctccctcaggcaatcgcagagacgctgcgctacaagccgccggtgcagctcatcccgcgccagctttcacaagacgcggagattggcggagtcgagctaaaagaagggacgactgtattttgcatgataggcgcggcaaatcgcgatcctgaagcgttcgaggatcccgacaagttcaacattcaccgcagcgacctggaagtcaaaagcgcattcagcggcgcagccaggcatctcgcattcggttcaggcgtccacaactgtgtaggagcggggtttgcgaagaccgaaatcgagcttgtcgcaaatatcgtccttgatcagctgaaaaatatccggctggaggaagacttcatttaccgcgagacagggctttacacacgcggacccgtctcgctcaacatccggtttgatgccaaacattaatcttgtgaaaaagccttctcctcccgggaggaggctttttcaattgctgcctcactgatcttcgccagctcttcaatacccttcgtaccttcgctcgcgtgtgaaagctcgtgacattgaacgattttaaaaccgttcattttaaaaatcgcgatgatatcaattctcccccggtctccattctttttgacaaccttgaccgtatatctgactgctgcgctttcgaggcgctcgtcaaacaaaaattcatgaaagggcgacaccgttatggtgcgtgcaacgtttttcagcgtccgtatgtgatctttaaactgcacaaggtcaatgtgactgccgtccgtgacttgaacataatcctcgctgaaataatcggcaattttttcagtattcatttccgacacgatgtcctgatacatgttgcttaaaaactgttgggcttcacttttattcattcgttgctcctcttgattaaatgtgttttgaccattcgtttaaaaagcggatgacggtttgcagctcggattcggaaaaccgatcaaacagctcgatgtagcgctgttttgcaatttcatgcatcctgtcatgaatgtcggccagttttttcccctcatcggttaatgtgtaatacaattctttgttgttgttcggttttttgtgcgattcgatcattccgtgctttgtgagcacattgaccgcttttgtcactgccgcttttgaaatttggagttttgctgccaggaaagcgttgttgacgtctgcttcgctttcgctgataagcgagataatgtgaagctgggtcagggtccaatgcttacgcatgctttcttcttcttgaaaggcttcctctgcgaacgcctgctgttcatgctgagcccgcttttctcttttgagaataaaatcctgaacggcttgaaatgcctgctcatacgtcttgttttccactgtcatcattccttttcacaatcattaaccggttaactattaaatagtttatcagttaacaataattaaagcaagcaaaaaaaagcatatgatgcagaaagatccgcagcatatgcttgccctcatacttgaggagatagcacgtgcttttcagtccaagccagaagcttcagatcctgtttgcagccggcgataaatgaaagccccaaaggctcgccgttttttgccggcaacgggacggtgatctgcggaagcccgccgagcccggcaatacacgtcagtttcatcgtgcgcgcccttctctcatttaattcgttttccggcagaccacggagcggcggcgggccgggggcagtcggaataacgagcaagccgtcttctccgagccattccgacagtctttttctcgccgcctctcttttcataaacgcttgcacatgatcgcttatcacaaggcttgacgcccattcaaacctttctgcgattccagggccgaacaccggatttgtgcgctcgatccaagctccgtgctcctcccaaatctccagtccctgcagcaccctgaacgtctccgcccattccgcgaggccgccgtcagcggcaacgcaccagtcgaattcgccgtcaatcaggcctaatgcataagcgtatacttgtgtccggtcgctttcttcaagcaggctccacgcctctttttcaaaataaacccggttgaaacatgcccctgcctcctcctgcccgctaagcaggacgcggcccgccgcatgaaggactccaatatcttttgacatccatccgacggtgtcaaaactctttgccagcggtatgacaccatcaaccgacacctcgccgtgcgtcggccgaaacccgaaaattccgcagtatgaagaagggattctgacagatcccccggtgtctgtcccgagagcgaaatcggtcatcccagaggctgccgccacagccgatccgcttgaagaccctcccggaattttgtccatggcacaaggattgacgggtgtaccataatggacattttctccgtcgaggctgtacatcagctcatctgtgtgcgcagcacccttaagccttgcaccttcccgcagcagcaagtcaacggcttccgcgtttttttcggcaggttcgtgcgtcctcagccaatcagggtttcccgccgcattagcatggccctctacagcaaacacatcctttaccgcaaacgaaagttttttcaagcttccttcagccgatggcggatcgaccatcagatcccggtttataaaagcgctccaatcatgctccattttcaaaatccctctatcaacttttgcttctaacgataaccggacgcctcttcaaaatgaacaaagttgtgacaaaatcttccgttccctaatttaaaaaggcctttaggtttgttcctgtaggcaaacagggtaaaataaaggggtgttgattacatattaaaaacaaacatgggagaggagaatgaaatggtggacaaggttcgcacagggatattaggatacggtttgtccggttcggtgtttcatgcgcctttattatcagtgttagaagattatgagattcgaaaggttatgacttcaaggaaagaacaagtcaaacaggacctccccgaagcagaagcggtcagtacgatcgaagacatcacaaaagatccggacattgatctcgtcatcgtgaccacgccgagcggccttcattacgaaatggcgaaagagtgcatccgcgccggaaagcatgtcgttcttgaaaagccgatgacagcaacagcggaagaagcggaagagctcattaatgccgcgaaagaaaaaggcgtgcttctcagcgtgtatcacaaccgaagatgggataacgactttttgacgatcaaacagctcatcaaagaggggcgccttggagaggtcaacacattccacgcctcctacgaccggttccggccgaatgtcagacagcgctggagagaacagaaaggaccggggtcaggtgcactgtacgatttaggttcacacttgatcgatcaggcgcttcatttattcggcatgccgaacggcgtcaccgctcaagtgaccgctcagagagccaatgcggaaacagacgattacttccatgtcatccttcactatgatcagcgccaagtgattctccactcgggctcgattgttccggccaacggcccccgctaccaaatccacggctcaaaaggaagctttattaaatacggaatcgacggccaggaggatgcactcagagcgggtcataaacctgcaggcgatgagtggggagccgatcaacccgaatattacggggaactggccacagtcgaaggcgacgagatcaggaaggaaaccgtggaaacgctcccgggttcatacttaacttattacaagcagcttgcttcaagtattctagaaggcggcagcctgcctgtcacggcggaagaaggacgcgacgtcatccgaatcatcgaagctgcgcaaaaaagcagcgaaacgaatcaaacggtgttcttaaacaaataaaacaaaaccgcggatatgatccgcggttttttcaaaaagtcctgcccaattctttggctcggacaatcgcattttgttttatttcttcagctttatcaggctcagcattatgcccttctataaataagccttcaaattccggaaccccgaaaaactgcatcatgatgctgatatagcggtgccccatctcaagttccgcagcctgcccttctgaatagtagccgcctctcgcctggatgtgcagcgcttttttatcggttaacagcccgatcggtccctgttcggtatatttaaacgtctttcccgctacagcgaccgcatcgaagtacgctttcatcaccggcggaaaagagaaattccaaagcggcgtgacaaacacgtatttgtctcccgcgataaattgctcgctcagctcattcaaacggccgactttagctttttcgtgttcagaaagctgttcaaagcccgaccccgactgcaattttccccagccgctgaaaacatccgcatcaatctgcggaatgttttcccgataaagatcaaggtgtatgacttcgtcatccggatgagcttctttgtaagattcgataaacgcttttcctgccgccatgctgtaggatgccctttcgtcatgcgggtgagcggtaatgtaaagggtttttgtcatttcttttgctacctgcctttttgtattgatattgcttagtatgggacgttttcaggcaaatattctggaaaagccggagctttcgcataaagtgcagatgctttttaatctgatgtccgataaggcttttgttcggcatcatgatcacctgctatattttcactctgctttcatttcagaataaaaaaggaacgccccgatttttcaggtcaaggcgttcctccattcaatccgaaagccgactcccttgcaggagcaaatgcaacttcgatttttatatgttacttttgtttacagcttttatgactgcgctgcatgttcctcttctttcagcttttcgagtctctcttgcacctcttcttctgaaaggccgtgctctttgacatacaggttgcgcggatgaacccggcactcgtgcgtgcagccccgcaaatagcggtgctcattttcttcagagcagatgatctgcttgttgcattccgggtttgcgcagttgacatagcgctcgcaaggctcgccggtgaaataatcttttccgacaatgacgtgctctttctgattgaccggaacgctgattctttcatcgaaaacatagcatttcccgtcccacagttcaccttgaacttcagggtcttttccgtacgttacaataccgccgtgaagctgggacacgtcttcaaatccttcttttttcagccatcctgaaaatttttcgcagcggattccgcccgtgcagtaagtcaatattttcttgccttcgagcttttctttgttatcgcggatccactcaggtaattcgcggaacgctttaatgtccggtctgatcgcgccgcggaagtgccccaaatcgtactcatagtcgttccgtgcgtcgacgacaatcgtatcttcctgctgcatcgcctcataaaattcttttggctccaggtattttcctgttaattcgttcggatcgatatcatcttccaggcggagcgtcaccagctcatcgcgatggcggacatgcatttttttgaaagcgtgcccttctgattcatcgattttaaataccatatcttcaaagcggggatcgcttttcatttcactcatatagcggtctgtctgctctatggttcctgacacggttccgtttattccttcacccgccacaaggatgcgccccttcagccccaaatctttgcagaacttgaggtgatcttcggcaaattgctcagggttatcgatatgaacatatttataatacaacaatactcggtattgattcttcatgatactttaccacctatctgatgcatgtttttataagataaaaaatggaatatccgtccatttatataatcaaaccttcattcatattaaaacaaaccatcaccatgatttcaatgaagcagcttgaacattccattaatcaaatgttagaaattttaacacttccggcggctttacgcaagcaaaacagctcagattaaaggactttcagcaattctgttataaactcccaaaaaccaggcacttcttggcataaaagcatctccgctttttcgcaaatcttcatcttcagctcctgttcaagatcctccctctcttgataggatgtgttgtttaatttgcttttgatcatcggtgtgaaattttccagcaatttctcaatctctttttcatcgtgcagactcactgttatcattcccctctgctttagaattcagcagctctcttatcttttcgagtgcccttttatgaatttttgaaatattttgccttgattctcccaaagagtcggcaatttcctgcatggataccccatgaatataaatttgtgcaagcacttttttctgcttgtccgtcaattgcaaaaacgcttcataaagcatcgggtcttgcaggtgttcgcttaattcctcttcctgttccaagacatcgtctaacagatcgcctcggggcggctcgggcagattcggactttcgtcgatcatcaatggaaaacgctctcggtttttccggactcttttatcaaagtcgacggagaaaatccggatcatcgagttgatgtatttgatcatgcggatgtttttgtaaaatcgcttaaattcacgatcgagacactctgcctcttcagaatccggatgttccaacacgtggttgaaaagccgctcataccttgggttgctcaaaaaatgcttcacaagcggatgccttgtgatctccttgattttcgcacgcagtaacgtttgatcaatcataaaaaccgcctcctatttatttagatgaaagaaatgaaaaaaaagtaaacacatctcttctattaacatgcaaacataagttcccattcagagaaaatagttctttgcttacatttttcaaactttcgtcacttcttaacataggaggtggtaagaatggacagcgcattcattgaggaagcagcgaaacaaatcggcaatgtcggctttccagctgtattggcaatttacttgctcactcgttttgaaaagaaaatcgatgaactgatcgagctgatcaaagaaaaaaatgaaaccgatgattgacatcggcctcacttttttcacttaacatgacagaaggggaaaacgaaaggcctttcagctctcctttacatttttagaaagaggggatatcacatggaaaaaaacaaacaaattccacagccgatcagaggagaaaaaggagcggaaacgaaaattccgcacaacgttgagcgcgaccgccaaaacccggacatgctcgtaccgcctgaaaccgaccacggaacggtgccaaacatgaaattttcattttccgatgtccataaccgtcttgaaaaaggcggatatgcacgggaagtcacagttcgcgagctgccgatttcagacaagcttgcttctgtcaacatgaggctgaaacctggggccatcagggagctgcactggcataaggaagccgaatgggcgtatatgctgtacggaaaagcacggattacgtctgttgaccaagacggcagaaactttattgaagatgtgaaagaaggagatctctggtacttcccgtcaggtctgccgcattcaattcaagcacttgaagacggatgcgaattcctgcttgtcttcgatgacggctccttctctgaaaacagcaccttccaggtgacagattggctggcccatacgcctgatgaggtgattgccgcaaacttcggcatttcaaaagacgtcgtcgcctctcttccagttgaagaaaagtatattttccaagaagcgatccctggctgtcttgagaaagacaaagttgaaagcccgaacggaacggtacctctatctttcagctacaatttgcttgaacaggaaccgattgtatccagcggaggaaaagtatggattgccgattccacgaacttcaaagcatcgaaaacgatcgcttctgcgttagtggaagtcgaacctggaggcatccgggagctgcactggcatccgaatacagacgaatggcagtattacatttccggacaagcgaaaatgacggttttcgctgccgacgggcatgccagaacatttaattaccaggccggagatgtcggctatgtgccgttcgcaatgggacactacgtccaaaatacaggagatgagccgcttcggttcctcgaaattttcaaagacgaccactatgctgacgtttcgttaaaccaatggctcgcgcttgttccggaagagcttgtccgccagcaccttgacgtcggcagcgaatttacaaaaatgctctctaaagaaaagcatccggtcgtcaaatttgataagaaataaccagccaggcttgcaggagacatatcctgcaggcctttggcgcttgtgtacatattttaaaggagttgtgtcatgaaacatttcattatttgctgcatatcggttatattcgtttttttcgcccactttctcggcatttcgatcctgtttcatctgtcgggcgcgttttaccaaacagtcggatcattgctgctgtttacgctttgttataccggactgacctttgtcctggaaccggctgaaaaggtgctcatccacagtatgaaactgctgggcatcaatcggcggatcacggtttttgccgctgaaatgatcacgatcggatgtttatgggccgccatttataccgcggacgaattgctggacgacgttctgctgacaacctcggcggaaatcatgattgccgtttcgttttttacaattgataaaatcctttatccgcggcagaggtccggttcgctcttatattgacgatccattttaaaccgaattttttcattgcaggactcaatgattcgcaacaatgttatatactggatttgcagtgattaaaaggaggttttgttcatgaataaggttcttttcagacccggcatgtcgatcaaagaaattggcgaacagttgcaaggctatatcgccgcaaattggaaacaaacgcttgacgatcatcgcgaagctcttttaaaggtgtttcccgaattggaagacgcgacttacggggtctacctggaccacctgctgcctcctgtatttgaaagtctcgaacagtccggctttacaacgattcaaaatgcgggaaaaggcgatttttttatcggaaagggcttgaactttagacagtccatggaaaaatggggagctgacaactgccgctcacgtgtgttttgggttgtcatctccgatcagcaaaaacagccggccgggacgctgctctttgacttttatcactctcacaccggatttgatgtccccctctccccgcggatttacacgttggaagaaacggagagagaccgaattgttgctcacataaaacagataaaggagaactagcttatttcgacccacaaagtcataagctgcagccgctgggtattccagcggtttttttatttacactaaatgcagccaaggaatttttgcaaccaatcaaaccacacattcgtttatgtataagaccaatatcttacataagggagaaactcatgagaactttcgaagtgttgacactcctgtcttttgtcatgctgtttcagcaaaaaatgccgggaaagcttgcggcggcagccggatttgtgagtattggcgtgttggcggacttgcagctttattcaaaacttttgaagcagctcggcatgacgggcgacatcgacggcgaacgaagcgcggatatcgtgaaccggtacgttttggatttttcaacaagcatttaaaagaaaccggtggtaatcttgtacctgccaacaaaactggtatgtaccaaggtcgtcaggttactgtaacagagcacgtccttggaggatatagaaaaggcgggaaatccaacagcccatatacaagttttacaataaatcaaaaggttgcaaagggctacggtaaaaatacaatagaactcgacatatctgctctccgtaaagccatcaggtctggtgaagtgaaggatattgtaattttatctcctaaacaaatcgaaaggttaatcaaaaatgatactcgccagtctgaacactggaaaaacaaagctttaaaatggactcaaagggacactgaatactttgtaaaaggtgaggttccaaaacaatttatcaaactacatccgaaggagtgatagatatgcttctatattataaaaatgaatgcttgggtgaaataaaaggcgctactgttgaaggtgtctggatgtatggaacaatcattcctaatgaaaacatggaaaagttcaaagatttctttaaggctgtagtaaacgaggatgacccttttgccattgaacagtatagtgaagaatggttagatgatgaaaattggtttattattgatgaaaagcaaaaaaaggtaggtatatcccttccagggatttacgaaaatgataatgaaataaattggagatggagataaaaaggcccctttttagaggccttttttttattacttcagtaaggattcgagttttgctttcgttttcggtccgtaaataccgtcggcagaaagcccgtgcataagctggaaccgtttgaccgcgttcgccgttttcggcccgtaatagccatctatgccgttattcttcgcccctttgtctggatagaaatagagggcagctaaagcctcctgaatctgccggacgaccgtccctttcatcagtgggctttttaccttatagatgccagaccgcagcgtgcaggatgattttttgccgcttgaagaaggctttttctattccgctgcaagagcttgcaatatgggaacgtccttgaattattatgccagtaaccaaacgtttttctcatgatatgaggaccgatgacccgacatattccgcagtatcattcatatgttcattaagcgattccccgctcttgcacaaacaacaaaaactccccaaaaaacaaaaaaaccaccatcatatgtatggtggagacggtgggagtcggatagataagttttacatcggtttagtaataagcgaaaaggctttgtatcaagggttttatgtttatcagttttccttggataagtataaaattataatgcgatcttgccattttcttgccacgaaaaagtagtgataagaggatgacctaacagaccatgaggtcatccacttttaataaaaagaaaaaaggacgagggaaaatgagtatcaacaaaatcagatcagcactgtataagtcagctaaaattttaggagatgttaacgcggcgaaaaatggaacgctagggaaacgaatggcccgccgagctgcaggaaaaacagccggcaaaatattgggcaagctgttcaagtaaaactatgtagaaaatccccctcatttgttttaaaatgtaaatgttcattataaaacaatgagggcttttttcacatgaaagcttggacatggaggggatatttcttagaatgtattgagaatttgttgttattattgagattaaaattaaggagagaataaagttgaaacgaacagcagagtttaccttatcattaattgcaacaatctttttaacaattggttggtttttcacagctattttcacatttttttatggttttacaccagcagatgaagctgacatgggatttttctattacttattaatttatacttatttatcaattccacttcttgtgcttatttgggttgcaacatttaaagtcaaagcaaacagcaaaggctggggaattttcattctaattatgggtgtcctttataccttttctatttactttgtgtcaggcattctcttgttaattgccggtattatgatggtcgcaaaacaaaataataatagtagtaatgttatgtctgcctaaattacataaaaacaacaaagccaccaatcgttaaatggtggctttttctttatacaaaatatgcaatgttctcggcttaccttcttcccaatcaacaagcccctttttacgcaaccggtcaagatgaccttttgttgtacttgaagattttaaaccaaccctttcacctatttccctaacagatggcgggaaacctttttctttagttagttcgtctatggcttctaatatttgttcggattttttcatagtatccccctccattggtttgttttacctatgacaattataccaaacattcgttctttttcctacaggaagagaacgtatttttgcatgcagagcattattgaccagcttcaagttcctgtttttaaaatgtatcttttttactatttttcaatattcagaggcattaccactcattttatggtaatctatacaataccaaatacattataagggagagagaaaagtggagacgatagctaaaagagtctgtaaaccatttatcctattgctaacagctgtcttattagtaacctttgttgtacctcaaatttcacaggcaagcgaattttcgaattcccaggtgaaaagctattccgattctggtgattattcagaaaaggaattagaggaaatattaaagttttacttcgaagaagttggggaactaactaatgagggatatgttattaaaaacaaggaattgtttgataaaaaagttttggagggcgaccctgctgccttgaaactaaaagaattaatggcgtcagactcttcttttcagaagtctagttttcaggttgctagtgcaacatcttttggtaaatgtgttgtaaacaaaatgattggtagttatggaaatatagcgcgtcaatttttaaatggtgctatctttacatatatcaaaactaagcagtatgatttagccgcaagattaatgttcaaaactttgattaaatctgggatgaaagttaatgcagcgtctcttgcaatagagttgggatactatggatggaaatgtcgagggaagtggtaaaaatgtctccattaacaatagttgaagtcatcttagcgttaaccgttttaggtttatttgcatggacatttaaaagtaaaaaaagtgctgatgacgatgatgtgtatagatatgcaaggtacatgatttatttacttgtagctgaagttgcgatatacgtcatattcagtttcatttaaaaaacccccatttgggggtttttattgtgcataaaagaattttgaatatcgccaaaaaattttctttactttaacagagattcaagtttcgcctttgtcttcggtccgtaaattccgtcagcaggcagcccgtgtatgagctggaaccgtttgaccgcaataaagtcgcggaccggaaaccggagagatcgttcaaatagagggccaaatccactacataaaccagctgcagaaaactttccatgtcatggattctaaaggagacacgaatctttttaaatttgaggatattgttggcgtggaaatgaaataagcccttctcacaactggaagggctttactcatcatatgggcggtattttttccggccagcttcaagttctttcttttgagtctccacatgatcacggagaaacaagctaactgtaccgaccttcttcacaggctttagcttcccggaagtcaccaatgcacttaaacgctgccttgtaaccccgaggagctcgcctgcttctgcagctgtcaaaacttcatcttggataaatttaattttttcgttttccttcatgccttttttcgctccaaatcataattaatccttttaacagtgtaactatcacagccaggtataaaatgatgcctgtgattttccccagagtaccaactttttcaaaatcaattgcaaaaatgcccgctattaggatgagcatagttgccatgtctaatgagctgtaatgcttaaaatattgtttcataatttgtggacgtgatataatgaattggagagcaaggggatttctccccttctctcgctcactatgtttagcgcttcttgcttacccggcgggagcgctttttctttttcttgcctctttttttgctttcgttttgccatatatcataaatgtgtttgaatatggtcaccactccagcagtggcaagaatccagtttcttacctcgtccactttagcacctcctttctatattttaattataacaaagctatttacaacagtcaatagcattgccaaaaaaagttccttttcaaataaaaagaactttttttggagctcaattatcctctgtggttgtgagcattcttgagactttagaagctgttaaatttgagttatgagaattaactttagctctttcctccccctcacgtacaatactatctataagaaatgtattgaatttgttaagattagaagtgttaagagtcattttgattgccgtacctgttagatcagtatcatagaggtaatgtcctttgcctttaatagaaagagcatttttacctgaacatatcaggaaatcccctccgtgttgacagattttacttgtaacaaacagtccatatccagaattatcccaatcagaatttgattgtcctcgcatgacaccattatactcaaaagccttgcccgaaattccaggctctatagacaaataaagagcatctttatcgttttttatgttaagatttgggttgacacccaaagcttgtgcgattccgacaccttcatccagcaatgcaatttcaactttatctttagatggccaatattgtcctgcaaaccagaaagattcagaagtgctatgttcaacaatgttcctcattaattctcgaatagagtaaccaagcacatctttaagattattattgccctgtgacagtacttttgcgagttcataagatttacgttcaatagttgtttgcactacttcattgcgattgtatgattctattcttaaatctctaacttttagttcagttataggaatatatgtattgcttccccatgcttctcctggtttctttccataatcaattctccaactttgaaaaaaccccatgtgtcctgcatattctttatcatgatgattatcgcaccaaataatacctgggtatctttccacgagtcttctgagcttcgatgcaaccataagcatgccaaaaggctctaccgtatttgaatatttaaaatcaaaaattactttctttatgccgtcaaagtcaaatgaattattacaaaagtctattgcatttcgagctgtcaaatccggcatatgaatttgtttttcatccataaactcagctcctttattaatcatgataggtttattttaccacatctcgcattgaatggctttttttgataggaattcttcttttttacccataattgaagcatgggagaatctatatagctagaacctgttaaattctcagtcaatagtaagaataacctgaaccaaatgattcattttcagtgatccacaggatttattccccaattggtttccgtatagtggtaaactttatactgattgtaaccaaaaggattagaggagaatgccatgaagacgctggatgttcaagcgctgcacaatgcaattgatcaaacgctggaacaattaaaacaacaatcagatgaattctctaaagtcaaaaaagcagttgagggcatcacatcacttgatgatgctttaaaaggaaaaggcggcgacgcgatccgcgccttttacgaggaatgtcacaccccttttcttcagttttatgatactttcatagaggaatacagttccacgctgaagaaaatgaaaagcgcgctgaattccctggaaccaaaccataacggatttatttcacagtcctttctcgaacacgagttggagaatggcttaaatgccgctgatcgcacaacaaaacatttggtttctaaggccaacgccacgatcgcaaaagtcagccatatcgtcgacttaccggatttgaatgacagcggttttcatgaacaaaatcagaaagcgttaaaggaaatcagcacgactcttgaaaagctgcatgcgtttgaccgcgagcaaaccaacgccctcaaaacggctgaaaacgatcttgagacgatgcagagatacatggcgcggctcgaaaagatgtataccggccctaaaattgaaatcacaggttaccaaaaaggcgcgattttaaagccggatgagatggataccctgagtggaaatcaagaaacagcgatgggtgccatgttgaaaaaagtcggagacaaagaagatgtggacactaacactatcgccgatccagaccgattaaaaaaattggcgacacaaaaggtttccaagaaagagtacacccaagaggaattgaatgaactgaaaaaagattatagagtatttaacgatacgctttaccgggcatacatagacggcgatacaatcgtcaagatagaacccgcctacacccttccagagaatgtggaaaaaagcgattttaataaaaatttcgatacggcgatggaatttacaggtgtgtatgatgcagtaagagcagcgtttggatatgaccttgcgacaggcgaaatcgttaaaggtaatggggatcgtttgatggccggattgagtgtcacaccttttggaaaggcatttaaatacggaaagcgcggcttcaagttatttaaaggtgaagaagcgggaaagaaacttgcgaaggtagataaaacaccttcctacggcaaacaatccgtaccaaaaggtccgtatcgcgaagtgcatggtttccctgcaaaagtaaaaccaggagctcaagaaaaacatattcctggaacaccaaactacaaacaagaaatagctaatggtcgtaaaaacaaaagcatcttctacggagataataaaacggcacaagaattgctagataagtttgcaggaaaaggcactctgttaaaaaatggggtcaaagagagagtagactttggcaaagtaataggaaaattctatgataaagatactggtaagtatgtggagactactagaggtttgatacattacagcaaaaacggcgctcatatagtaccttcagagcctttaaaaccttaactgaggaggatataaatgggatatgatcctttaatttcagcattaagaaagtataaaaataacgatttgataatagaatggaaaagtggattaaaggttattggagaacctgacacactctatgaaacagacaacggattggacgatgatgatgtcaattatatagaatatgacgcagtcgcatttcaagtaaataatattttatcccaacccactaataaagattgtggtgtatatgattggttaagacaaggagaaagttccttaattgaaatttcactttatgaagatacaccaagtgcagtatatttaacagacggtcagaaaatatgggagatggatagtgatgaataacaattgacaagttagaatttataaaatctaagccctcttgaaagagggccttttgattacttcaataaagcttcaattttcgcctttgtcttcggcccgtaaatgccgtcggcagacagcccgtgcatcagttggaaccgtttgactgcgtttgccgttttcggcccgtaatagccatctatgccgttattcttcgcctctttgtctggatagaaatagagggcagctaaagcctcctgaatctgccagacggccgttcctttcatcatcgggcttttcactttatagatgccggacggcagcgtgtaggatgattttttgccgcttgatgatgattttttctttttcgcttcaatggccgcgagcgccttttcggttgccggtccataaattccatccaccgcaataccggctttcttttgcagagctttgactgcctgcaccgtttcatttccgtaagacccatcagccccgtatttcggcagtgagaagccagcggcaatcaaacgtttttgaagcgccttgacctgggaaccggacgccccttttttcagaatggtccctgtggatttgcttgactggctcgtggatgatgttgtctttgacacagtgttatttccgagcaaggcatcaacttttttcctgaatgtcgtcagctggcttgcatccctcacccagggagtcggacagcttttatttgtcacatcgtaatggcggacaattttgtttgtagaaaggccgtaacgcttgcacagatcggcaaccagttcagcagcattttgaatcgtttggctgtgaatcttgccatctttttcgacgcacatttcaacaccgattgccgttgtgttagcgtttggttttaaaaagctgacataacagcgattttgatcatgggcatgatatgcgacttcgttttcagggatgatgtgctgcgcctctttacggtccacaaaataatgggctgaagcgtaacgtttatcagcgatacatgtgccgttgaaataatttcgctcattcagtgcggacgcgccaggagtagccgtccagtgcatgacaatccctttcactcctgccaacttcaaccctggccgagtatattgattgactttcacataattcttcacaactttaaccatctgaaccactcctattttgttttaaataaaaaaggctgccagccggcaacctcatttcgttaaccctttttgttttagaacttctttttgctgctttcctttgccagtgacatagttatttttgaaccaagcgaccacagacgtaatgatggtgaatgccgcagagccggccaaatacaaagcgtctgcgagcgtgttgatctgatcttcactgattggaagaactggcttcccgaatacgatcaaagtctggtttaccaacgcaataaaaagaagcaccgtccgaacgaccgtgcctttgtcgaatgttgtcatattgtgtcttcctccttatttttgaataaaattaatgaaaagcgccgcaatcccggagatcaccagtgtacaaaccgctgtgatgatcgcgcccgtaatgctgcgcttaatccatgtggtgttctcttcaattttgttgagcttgtcattgatggacataatctgttgatcgtgtcgatcagacgccctttccagtgtgatgacacgctgttcaagcgttttgtgatcggccttcaattcggtaatctcctgcttgaagacgtcccattcatttgtttgatgcatgtcctgaaatcctcctgttctcacatcgttttcacctcctttgaggcaaaataaaaacacccttattgggcgcttgtcattcctaaatccacacagacggcgggtttgtcataactccggcctgttatttcttcgtattctgccggagtaatatggccccaatctacgtaatctctcatgattgagtcatcatcataacaaccccaatcataaaactgcttaatagccgcaaagtctggatacatcatgaagaaccatcacctttcaatgatgcaacttctttttgaagacgggccaattgataagagagtaaagcgttttgcttttttagcagctcaatttcactcgcttcaggctccggaggcagcaagctttcaatgtactcttttgtagccgtctccttccagaccttttcgtccggataaaatttcggaaggtataaacccgggtcaaatggaatgtccgtccatccatccgggatttcatagttcccttgatcatcaggctgaataatatcattatcaatcaataagaacgtctctttgtcatatttaaaaatgtttttcatgacttatctctcctacaggggaataatttcgtccaaaccataagaagttatgttgtcggacttatcagcgatttgcccctccagcctcatatttccgtttgtttcgatatacaatttggtcatccctgttgtaccgaatataggaacaagtctgctgcggagctggtcaggtctataagaagctggtagcgtcccaaagatcacgcctctattggtaatgatctcgccttttaaacacagaaaaccgccaaccaccgcacacataacttttctagccccatgtttcgcaccgttttttaaaggaacttcagtccagacaggttcaaagtcagtggaagttaatattcttttccaacccctaaagtcaccatttgtatggatggtcgcgaaccacatcttattgtggtaacttgctgtggctataattgtttttcttccagagtttccatccataatgtcataattgaaccatccagcatcatcaggcgcagggttattaggcagtctgttattgataccgtaataaaagccaggtggcaaagttaataaatcagtaccatcaggaataaggattcgcactccattatcttgtgtcaatttatacagttgagcattgttccatttggtacgttcggcagtcgtcacatgaattgtcttattatttgcatgagactcagcccgggactccgcctcattccatttatcacgctccgctgccgtgatatgaatatccgtgtttgtggcatgagtgtctgtgtattccttcgcgcttactgccgctttgtccgtgtattctttcgcgctggctacccctttgtccgtgtattccttggcattcgcttcagccttattcgccttttccgtcgccccgttttttgtttcaatattttcaaactccgcaaattttgctttgatctcatcaagagtttggctgatctccgccaccgttttgttaatgccagcccggagcgtttcaaaatcgtcaacataatactccgcaacaggcacaatgttttgatcttcgagagttttctcgatgtagaaggtaaaaaagaccgtcgcaagcgcctgaccattcgtataataaagcttgatttcggccttaacttcgccgtaatgcttgagttcttcgtcagacaaaacatattcggctttcccgtttaccttgtccgtcagcgtcaggctgcgtttataaaacgagtcatccgcatacagaaggacaattttggcgtctaccgccgaaaggggcaatggaacggcgtcttttgtaaaagaaaaggacagctttgcgctgcccgtatcctgggtgaaaaattggatgttggttgattgtgcgctcgatttccgcgcgtttatatcaagtgatataccaccttgtttataaatcatcaatgagcctcctttacagctgcggatacataaagaccagggcgacaccatatcctttttgatgagagtaaggctgcttgatacgcatcacataaaagcctgttccgtcttctgatttagtgccaattccacctgtgggcacgatgctgtctcctgcctggaccgtatcatcaatcctgacatagacctggccgaccagccctacaacatgccactcgtcccgctcttcccgcggaatatattctatatccgaatcgtaatgtgggttttcttttggaacgagttctttttgaatcaccacattaccgtctttgtcttctgattcaacgtcgatttcttcataaatgatcccgccgaactcatttcttaaatagcgatcattccaataaaaagctgcgccgcccataatgacgccggccgtctctgaaataacgcctaaaactttttcacctttttctgctttcctaattctatcgccgtccaacgttaccaggtaaccggaatcaatcttgctgccgtctttggattcaaagtattcagccaagtcctttaagtcagaaacactttcaatacgaccggtgcctaaaacattcccagcctttgcgtttatctctacctttttatttgaagccgatggactccctgtaccgtatccaagcgccaccgtatagctcttattgttgatgacagcttgtgacgataaaattgtccgggatactccatccccctcaatcctgacattatttgatgctccgatgacagaccggcttccttcttttgttgcggtcgatctatcagaagaaccaatcaccacattccgcgtaccttgtgccttacatccgccggttgaaccaatgacagatgaagcctctccggaagcgacaggatcaccggtagaagccgcaagaaaaccagtctctgatgtcgcatatcctgaagttgtggcaaccctcgttccgccttttaagttgtttggtacatatttatacttttgacctttaatcatcgcagcgtaatcataaccctctgcataaacacccacaatattggcttggctgtttggtgaagtgataccgtaagcacccttgtcccctgtcatgatcccattgttgatattaacgttatatactcccccgccaatcacaatgccgcttttagcagatttataaaatgtgaagtttgaaatgttgacattatcagtacgctggtcgcctccaaaaagacgaatatccgcttcagctttcttaaacccacgcacttgaattccattgagtgagatgtttcggctgcgatattgcagtgcgatagcgggatagtttttataatcgtatgaaggatcaccgatagctgtaaaaccgcttaccacgacatttttataggcggaaatgacaagcgcacgtggtgaaagatccttatacaaggaattaaataccggttcaatcgccgtgcaatctgttaatgtgacaccgtaagctgtcgtgctttcagggtcagatgctaaatgatggccgatatgacggatatcgtatgaccgcacatcacgataagacacatgaccgataacatggacattttgagcagccggccatttggcatgagctttaacctctacgcccctgacatttccttcagaatagcaattcagtatccaagcgtgctttgaaccgtcgtcaatttcaataccgttggaattggactccccctgtttatgagctttgccacttggataaacacaatgtgaattggatatgaaaatatattcgctgtaatgtgtggtaatcccatcgtcgccatatccgtatgcaacgcaattgtctagccatatataacgactcccgttcttcgtataatcggttgttggcaaatgatcataagtaggagctgtaatatcaaaaccgtgcagccctgggtttatcgcctcaacatctttcacccagccgtatttaacattggcaaatgttaagcagctggaatgttgcccgccagtcgcccgaactccgccttgtctattcggattccaatcaagcgacatcccctgcacaaaaatatttctgtttccctgctcatagtctgcatttgtaatcacccattcactggcgggcgtattctcatgaagcttgatggtcgtgataccttttccctttccaatcaagtacgtccaggatgggagcttgatgcctttcacaatataagtaccggcacttaactcaattcgcacccgaccattccctaaagcctttttgaaagcctcagtgctgtcggtttttccgtccggaacggccccaaagtcatctacatacacagtgcgctttattttttgtgcgagtctattaaattctaagtccaggcgatctttcaatgtttgagcaatttctccgtcagttgtcacccgggcgtccactacttctttgacatctgaaccgtcgtgatttgtgactaggttggcaaagcgtgctgataaatttttcagacggtttccaacagtaaagccgccgtggtcgatttgttccgacgtgtgggcggctctggaagactcatgtcttttcaaattataatcgtgatcattcaaggcattttctatggattgcatatcttcacttagctgggattcataaagtgaattacgggttttattatagtgcttaatcagccgcaacatgttcatcactccctttttggcaaaataaaaaaacgcctacctgagcgttttgaaaagctggtcgatatatcgtttttgatctctaagccttttcgcttgatccacatttatgctttggatatctttgcggaagttcgcaaacgtcaatttcggactgctgtatgggttcagagggttgtactggatggacacaagtctcacattatcttcaaatgtgataccatccgccgtatcagccaagacatggattgtgtcacctttccagaaatcttgctcgatctctaaaagcttcggctcatagattttttggaaatcagcttctaccgtcatttccggatatggattcacatgcctttttaatgcagaaatcatactgctggcttttttatagcgctcatccctgatcggttcagcccagcgtggcttcccttcaatcaagaatttcttttcgtctggatgaatgtataaaataggctcaaactcgtactgagggtttttgtcatcagtactgctccccttttttaaggccccgtatccccaggcacgtgttgtactgttttgcgagtttgttgtaattgaaatgccgggcatattatagcgcgaatctagggtgaaattaatccgtttccccatctttttgtagatataaattttgtaattatccacgtctatttcaatcccataatcctcaatgatttcatccattagctctgtcgagtttttatcaccgaaattttcttgatctgctgattcaaattcactctcaggcgtcttaaaaatatatttgaagtctgtattcttcagcgcaaaatcaagcgcatctctcaatcttaatttctttgatacagtttcatgaatcctgttgttaataagcagcacagtgaatatgtggcttgctgtaacggttttactaataacatttttctcttgatgaagttcgacacccgtaatgtaatatttttgatgtttaaattttttctcatccagataaagtatgttatcgtccaccaataaatcaaattctgtgccgttctcctgcgtttttgtgatcgtaaaggtaaaactcttcttacctgtcgtatcgtctgtcagatcaactgacacacccgttatttccacaaccttttttccgtcttttgttgacacatgaagctgtgggaaatcggtatctgacggcagattctgattgagtgttatatctttcccgtcatattccttgcttggataccccggggtaggattcggttttgtaggctcgtcaggtccatctggcaccccatccacagtgtcatattgtgttagattgtaggtttggatgaggttattcaactttgttgcatagttgggatcggaagcataaccagctttaataagtgctgctgttgcttttttgtagtctttttccccgaccacaactttatactgattcgggttccagctcgttccgttcacatacaaattagctaggtcttgaattgattcagtccaagatggatatttccgaaacttggcttgtacacgagttggattctcgttcttatcatattcagtcgtccacataagaacatattgaccgttataagtccccttgatgccgaataagtttttccctttctgcgccagctcgcttgtaccccatccgctctctaaacaggcttgagcaataatgagagacgcgagaatatcatactttttatagactctttgggcgtctggtgcaatttcctttataaaatctgtgtttgccatattgcatgctccttacgcgtagtagaaacgggtatcaaatatgatttcaaaatcattggtattcaagatttcaaacttattcattcctatatcgagtcccgggagtctgccggatgttttgataggtgttttattgatcactgtgtattgcttaataaaagaaacatgctgtgatttttttaattcctgttcaattttcagcttttcaccatttgtatggttgatgatcgtcacattttttccggccgcccataaggtcacattgtagtcatgttccaaaggattgatataggcatcaccagtgttataaacctgaaacctctttcgatttttgaacctgtattccagatcgtcacgcatttgaatgttcatgcctgggctccaatgctcaacgtcaaaattttgctttgtcagagaagtgaatttcgattctgccagtcccgtgatgttgttaaattcaactgtgaacgttacaaagtttttctccttttcttttgggatactaaaatttccatcacaagttacccgaaaacggagattcggcaataaatcggtcgagatataatagggaaacggcttaactaaaagcgcgtaaagctcccgtctaaattgataaaagttttcagcgatgattgaatttaaataaaattcaacggttatttttctttctttatatgtgacatcccttggatgctgtggaaggacaactccgtttattctcgggatgctaactgtctcgcgttcaatccccggtgcttcaggtgtgaagcttaaaggttcaaaaaaaggaagcaggctttttaagctctgctccccaaggccattatcgtaatcaaggaataatttcactatctcaccccgtttataaatgaagttcgagtaaaccgatccccggctgattggtcaatttttctgccatcaagatatgtgttgctgtcctttaataaaatctcctgcaaaagctgtacatttttatttagaaaatcaatttgctttgccatcatactgatttgtttttcttgattctttacaacacggctgatgtctacagaaaaatcattaggcggtggtagctgctgtttgggcttttccgaaactttttgaagcaggagaagtgcttttgaaatcatcccatcctgtaaatccggaagtacgccaagtttgctaccaatccgagcccatagcccaatattacgctccctgtatgaagggtcttccgtgattgttgtttcatcatacccccgttcatttaaaatggcccatttagcgccgccacgaccaggtgagatacctccttttgcataaccaacatagccgccaccccgggccattgatttcaaacccggatgatttgatatatctccatagcgtgccttgatatagttaatggctgcaagaatgttgtctacaggatttaagatgttattatgacccggaaacttataggcattgaaagtggacggaatcgtttgcatcaagccctgacttggatgtccggctttggcgttagaatcccataagttgatggcgttcggatttcctccgctttccttcatggcgatggtcacaagccctggaatccatgaaagtggcacccctgctataccaacagcctctgtaacccacttgtttacggctttcgttccaccagttcctttaaaagtggacgactctggcatgactcctttcaggaatttagctgtcccatcttttaatgtcttaagtataccggttcctaacatatcgataccttttcctgttttgtaggggatcagaccactaaatagttttttaattaatttttttggtccgttaattataaaatccatagcacttgaactaacatccccgactttatccacaacactttttccgaaagaaatagctcctttgaccattttcttagagctttcagcagcttttttaaaaaagttcccgactccgcctgcatatccaggaatccccgaagcagcaagtttttttgactcatcatgaggaagtacagatgttccacgcgggagatcccagatttgcgggccgcccataccgactacatacgttccgatgcctggtgtatgggctaactcccatccttcttcaccgacaagcgcttttcctccagggtgaaaatctgtacctttcgcataatttgcaccaggcgcaatttgcattttagaagtatcttgataaccctttggcttccattccggaatcttaataggaatatgaagaaattcaaaaacgttattaatatagccagtgatcttattcattaccccagctaaatcatttagatgaatattccattcctcaagaatttcacctgtctcccaatcaacctgaccaatatgtccataagcttgaagctttgcctccttgactacacctttatgcgtcttttctgcttccttaattgtttttttggcttggcttcttgctttttcaacagtgtcatcgtgttctttctttgaaattgtgccttttacataatactgatcatcagcagcagcaataacggaatcgcgctgcttttcggctgcttttattgttttttcttttgctttattactatttttcacaacagcagcagcctgtttagcagataagttagaggattcttccttcagcttccttgaaattttaatttgctcgtccttgcttcgagtaagagccgtctccatttcggcaagcattttcccttgaatgtttgtaacttcttcatattctttatccgtaagcttacgatgttcttttgcggcgtttcgataaatcttactaatacgatctacgtatccttgtattttcttttgttttttttggtttccaacttcaattttatttagaatcttagctgcttccttatctgaggttttatcattggaagcataaaattcctttaataccttggtggctgaatcagcgcttgtttggaatccttttttcaaagtctctcccatcgttgtaaactgtgttgcgacatcgtccgctattttcttggtgatttttgcattggttatacggagatattcaagcttagccgtgacttttgtattcatatcttcataagcattcacagcttttgcagtagccttcgaaacccctttaccaaagtcaatagtcgatggaagaacccttttcttcaggttgtcataatagttcatacctgcttccgtaagaagggttacacctgtaatagcaagaccaactggaccgcctaacaagctcaatccgccacgtaaaaggccgacaactcctgctccttttttgagaatgttgaataggccaaaaccgctttttgctaatttcataaagccgccagcgcctttaattgcattggctccaacctttaaaatattcccaccgaattttaagagctcaggagcaaatgaaagtattagcccggcaattgaaccaactggcccgccaaacaatccaaggccaacgccggcaacacgtgaagcaccgcctaggcctcgcatggctttagcacttctgctggatgattgttcaagcctcccgactctggttgttgccagattggctgactgatgaaaacgccccattcgtgtggatgctgctgccgctgccgcagatgttgttgtcattcctgcagccgctgtcctggaagctgcgcccgctgcaatggcttccgtagaataaacgccaaggctgcccgatgcttgatttacattccgcgttaaatagccgcccgcggtccgaagcatattccagcctgctgctacttttggcaaagagccaagcaacagtaagaacgcgccgcctaagagggaaaatacagtgactgcaccgccagtaatcgcaatggtactcgccacagaagggggcaatgaatcaaaccaggttacaagctttgttagtccgtcagctgtagcccggataacaggcaagaactgatttccaaaagtgataacagcattgtttgtagcagatttcagatactcaatagagccagccaggttgtccatttgctttttggctactctttcagctgtgccgccgcttccttcgatttcctttgtgaattcttgaatcttatcttttcccgcgtgcattaaagtaataaatccagaaagagcatgctgcccagccaactgttttgcaattcgaattttttcagtttcggtataatcttttgttttctcattgatctggccgataatatccgcaagtggtcgcagtttccctgtcgaatcggttaccttcaaacctaattcatcgatcgcatttccggcttgttttggtggagatgataaacgggtcagtgtagctcgcaaagctgttcctgccatatcagccttgatcccgctatttgccataatgcctgtcgctgctgctaattcttccatgctgagtcctgccgtttttgctgccggagccgcatatttcatcgtttggccgatctcttgcagggtggcgtttgagttggtgaaagtatacgccatggcatccgcaacacggtttgtatcttcagccttgatatgaaattcagtcaaaatgtcagaaacgatatcggccgtaactccaaggtctgtttgaccggctgcagcagtcgcaagaagaccaggcatagccccaataatttgatttgttttatatccggccatcgcaagatactgcataccttctgcaacttggccatcagtatattgagttgtcgcccctaaatgacgagctgtttttgtaagatcagccatctggtcgtttgtcgcatttgctaaagcaccgacacgactcatcgctttttcaaaatcagcggcagctttaacagtcattccaattccaaacgatcccgctgcaccgagagcagaaagagcctttccagcggttgaggctgattgatatactgcgtttaactctttagatacttctcctgaattgcgcttaaacacagaaaaaacacccgctgctcgccgggtgctgtttgtggtattttcaaattgttttgttactcgttgcagttcattcccaaggctttgatgaacggcaattgcatcattcagccgacggccttgtatctgtgtttctcgattatccagccctttttctctgaccagcttattgtattttgcccgatgctcatcaactaaacggccttgtatgcggtatttattattgagtccttctatttgcgattgaagaaacttagactgattgcccgcagctttataaactgcaccagatgctttcatttccgaattcgctaaacgcatttgccgctttaaaccttcgattccacgattaaagccagtatcatcaaggcctactttaacaatcatatttccgataggttgcgccatatgtatccaccccgcttccctggcataaactcaacgaaaaaagaccggcgataaagccagtcttagaaaaatacttgatcaattggaacaacttttggtttattttcatgagccaggacttctaagtaatggtaaatatccatctcgtcaatttcagtcatggtccatccctgttttaaaagggtcgcatatatatcattgagctgttctattccgttttcaactgtaagtcctccgtttccgctgctggcaaaaaatcttcttcctcatctggttcttcatagcccatgatttctcccataattcgccttacttcatcggaaacttcaaaggactgtaatccttcttgaaaatcctctaaagtaaattgattgtgaaatacccgtacaatgaatttcatacgatcctcaaggcttttgagtacttctttaagattttttgctttagaagctgtctcatctaactttaaggcttcaaacaacgtctttgtgtttgtacggggagcaataaacgttttatattttccttcttcttcaaaccataatttaatagaaatatgtttttgagccatgttgactcctcctttattttgttagatttaaaaagaagcatagagctcccctttatactgtctttccaatgtctacgctggatttattatcagggcctgagtccggatttttataagcattgccaaacactttttcataaaacttgtccaaattgaaattcggtgcgtcctcatcagccaatactttataggcgttgtcttgttcgcgctccataaattcagcagaaagtttgaccgtctgaaaatcagtcttttcttcttttgttttccattcatcatccggaagagaaaaacgccctttcactaagcctacatggcgattcttgccgttggcttttggcccatagaaagacatagcaacccatggcgcgataacattctttttgaacatatagatcccgtctgtttcttctatcccaaacaattcctccaaaatttccattggcagatcccgcatttcaagctccaattttgtggaaccagtcgtgacagccatatccaccagtttgttgtctgcatactgcttttctgttgatgtttccgtattgaccttcgcgttaattgcgtaagggtaatcaataatttttgtagccacataaaagccattttccttttttaaaggcgcaaatttaacgccttccaatccggtaactgaactgtattcaggcattctaaaacctccaattatattaaaatattggcctcaaatcggcgtcccttccgaataagaccctcatcttttaaaaagtcattgattaaaattcctgtttgaaaatccattcgattcatgacccctataacggcagccaaaatctgatcgcaggatgaatcgttgtatacatcaatttgatagacagcgctgtccttgatcggctttccatcagcccacttggtagttctgtagtccaattcctgtacgacgatataagctggtttgcttttgatgccaatcggcaccgcaagttcaaaaatgtttgcaggatcagccaataataaaagcgccggatcagtttccagcgcttcaaatactttattttttaattgcaaagctctttccgctacattcatagcttgtaccctctttttataacgcttgccatcgcctgaagcatcctctcattggcacttagcatactccgctgaatagacgggttagccggctgatgaatggttccgaattcaggcaagtggacacggaacttcgtatcttttgtaggaccaaccactgcatatatctcaccatcgggatcctttctcgtacgattaccaacgataatatcttcatcaatgtggggatggctccccccaatattagaacggggagcattctttttaatttccttcgcaagaatcgcgccaccagcttttacagtggctttatttatcgattcattttcccttgcaagagagcttaaatatgaatctaattctttaaagccctgcatttccatttcgatcttcattattccaccgcctttgccctaatcatggtgaaatttttccgggaatagttcggtatgatagattcaatttcatacaattgattctgaaaaagaatccgcatatgttcgtcgatatcctcgcggtgtcggatcgtaaattttattgtcttctccttctgcaccgcggccgccgcgtaatattcccgaccttttagcccttcggcttttgcccagcattcaacgaccgtttcatagtcaccttccacaggaagacggccgccttcttttttcttttgaaactttatccggtacctcatgtcattcagcattggaatcagtctccggaaccgtatattttaattgattgatcaacgttgtcagaactccatcaagatttgaagtcgtgccggccacttcccggttttcataccaatgcgtaacaaaagcctttacacacatatcagcccgcgctgaattattaggaaactccaacccggttgcagctgtaatgtattcttttgcagaagcgataaacccaagaattaaatcatcctccagatcaccatcgacccggaggaattttttcgcctcttcaagctctttttgttccatttcagtcatagggcatcacctatccttcgttagctagatgttccgccacctttaattcatcaatttgcttttgtaaaccatctaaaacagcctttacttcgctgtttaagttgtccaacatgacgctgccggttccgaggttgttgcttctaacagacttgtccgcaagcatttcatgtaggatacttttctccccaatgtcagccggatcacctttatcacctttcggaccttggggtcctggctctccctgtggaccttgcgggccggtatctcctttgtccccttttggcccttgaggtccctgcggcccaggttccccctgcattcccttaatgtacaaaggattatcctcgctgtttcctttcaaataaaccggtgttaccggctttcctgtaccgtcgtcctctgcagaagtatagactccgttactttggtttaaaaattgatctgccatatctcatcatccttttcaatttttttattttccaacgtcaactgatttatcttctgtgttattggtacttggagtttcattgtcaggaacggcatctttaatagatgaaaattctgcatagaccaccgcatcagtatcccaaagaacgacgtcctcacgttcaatgattcgcatatctgtagagttacgatagaatgctttaccaccgacatttgtcgttaaaatggaatattgctgacgatcaaagagtttgacagcttctttaagatctccaatgattaatggatattttggagtcgtttttgtaccgccgtttggcaaatacttatcagaaatgacggataccggcttaccgaacaataattttttagttggatcagtagggttcggctgaagcaagtaacggccgaaagcgtctttcagtttatctaacacgttaaatcccgattggttcgtgacaaccttagtcgtggcattaatagccggatcaagtttgacattgagaatgtctttaatgtcgtcctgtttcgatattgtcgttttcgcaagtgaacccaattgttcaagaatcaatgtattgcgggttacagccgattttttagcgagccaattggagagatactccaaaagcgcctcttgagtatccgcaagtaaatcatttgagaggaccaaaatccctgcatagtctttaatgctatactttatgttttcaaatttagggttctctaattcttcaatatctgctaattcctcaagatttactaacggggtgatatccgctagtttttcaagaacccttgaccctttgtttgttgataccggaatgacatcgactagatttgccaacgtatcaaattgacgtcgtttttcatttattttcgtggagatatcctgcggtacaataagcccgccgtcctcatccacaccttctttcatcgcggcaagaggctgtggtactttgcctgttctaagggcagatgcaaaaagctgaacatgatttttcgcatctgttttggcgatatcatccgttggctgttgcgggttctttgcctctggatcatgctgcggctcttcttgtgcatatgaaacctgcatgtttcgtaaatcctcatatgtttgaatttgatctttaatttgttgagcctctgcaagtagttttttggcttcatcaagtttgccctcatcggtcaatgcttcaatgtctgtacgtttttccgccaaggcttggcgcaactcccgttcttttttagacattccgccaccggcgaaaaattgaatatcgagtttcaaaggttttttctgcttcaataggcttttttgtttcgatagctttttcaaatgcttgtcctccttaaaaatggcataaaaaaagaacccttaaagatttaagagttcaagtttcatagtgatcttttgttttaatacttcatccggcttagtttcttcagccggacttccagcagcggattgagcaacaattttgcccggaacatgtttaaaatgtgccagtacctgatgatcaatgcaggctgctacatcctttgattctgaaaccatatcgatcaagccataatttaaagcttcatcggcggtgagccaggtttcctcatccagaagctggcgtaaagtcccgtcgtccagtttgtctcctgctttcgcaagatatgtggaaacgatactttcagtaattttgtccagatcatcggcagccttccggaattccgctgcattcccgaccatccccatgtatgggttgtgaatcatcatcatggcgttacttggcatcgtgatgatgtcccccgccattgcaatgacagaagcaatacttccagccagtgcatccacatagacattgatttttgccttgtgacgctgaagcatcgaatgaatagcctgcccctcgaaaacatccccaccgggcgaattaatgtacaaatcaatagagctcacgtcacctaaacttttcaactcagcctgaaaggccttggacgagctctcgctaaaccatccttcgccagtaatagaaccgtaaagcgtgatttcagcagtcgaatcattcagaaccttcatgttccaatacttgtttttcttcttctgttccgttgccatcaccccctttcaggcgatttgaagaccgtttgaccttgctaagttgatactctttcataattgaaaggggaacaaggtttaagtttccataatgctcatcgccgatctccccgatacctgtcatgtcctctttttgaagaatagtattgacgctaaaggcgcctacgctttgcatcgttttataaaattcagcacgtgatttactatccccgcgaagctctgattccaggttaaatttaaagtaatagcctgctccccgctgcttctctgtcaaaaccttatcgtttaattcttgttcaatatttgtgacgattggctgtaaagtggttttgacataatctaaggattgttgctcaatatttgaaaatgtcgcccgatcaagctcacctattttatgaggcggcaccttataaatcgatgcaatctgctggcggttccatttcatcgactctataaattgggcatccttcataggcattgttacttgtgaataatcgagccctgcgtctaaaactgcaatagactgccccgcattcacccgctcccagtcttccctaagaatttgtttactttttcggtctaaaagggtcggcgcttttacaacgccaaacggtgcgccgccattcttgtaaaatttcgcattaaattttgtggcagctctatttgaccctatattgtcccgaataactgaaatcggggtttgacctacaattccatcaagagacaggtttttaaaatgcagtacctcttcgtaaaaaaattcacggtacttgccgtcaagtgtggttgaataccatacccggccgttatttggatcaatattcgtatttgtcgcttcaggatctaatggtctgatccccgtcacatttccgtctttatcaaaaagtaaaaggttgtagctgtttccccaagtgcaaagccttgtaaccaaaagccgcttccacacaaagcttgtcatatagtcattgactttgttcagaatgatatcgctgactttattttgaacctgttgtatgtttccattttgattctgaaaaagtttaatcggcagtttcgcaatatcatccgccaaaacaatcacacaggcatatacatccggatgaagaacggccgtttttgttgataccctttcaccagatgcgctttcagatccagcaaaaatatttttgaaccaatcaaccggatggagaagggaaccgctatcctcttcagcaatttcattttttattccgctctttaaacagcttaatagcatctatttccctccctcatccttatttttttgacgaacaaatcctgccaagctggcaagagaaaataaaaaaacaccggttgcgattaaacccgcgtttacgttcatccgatatatggctattgaaatgaataccatgcccgcaataagcaagatatcctctaaaaatagctgtaaggtttttaaaattttcaagtgctcaccccctacagactgaaagatccagactgaatataagcgtttaagtcgatcgccgtatcaatttgtgaagcccgaacatgtgcattaataagcgcggctgccgggtcaatccgttgtgtggacttggacttatccagcattatattttcctgggcatccacttttgtaacggcgttccccatagcccaagtcagcagatcgtttttattatggatgatctttttcgccttcactttttcgcggaagtctttcgtaggctctgaaagtgtggcaaccccctgccgaatttcaatcatcacatatccgtctgcctccatctgttgggcaaactgtgtagcgttatacgggtcataggcaatttctttgatccgccagcctttctctttctccatttttttaatgtaagccctgatatagtcataatcgacaacagcgccgtcggtgacggttaaccagttcttttccttccacaaatcatacggcacgttatctgtcttcatgtgctcatagaaggtatcttcaggcataaaaccgtgactatccacagcaaagctcccattatccaatgggaaaataaacgagacagctgtcaggtcaattcgttttgacaagtcaatccctacatagcactcacggccggatagattagggaactgatcagatccgcaatccttccaagcctgcatatccatgtatccaccgtcgcgcatattaacccaaacattcatattcttggtcaggaaatccctcatcttttcaggaacagccagagccatttcaagacgatctcgcaaatattttttcccaacttcatgagaagctaatatcggattagcctttatccaattcctttcatcctttatgtcatcgtctttatctatttcgttcaccatgacaaaatactgttcatttgtctctactttgtttggatcgagaagacgtgaaacataatcatactccacacgataggccggattgtttaactcgtgccccgctgtcgtgataataaccatgatcggctgcgttcttgcgcccatccccgactccaggatatcgtaaatctctgacgttttatgagcatgatattcatcgattatgccgcattgcgggttaaatccgtcaccggtcttccctgcatctttagataaagctttgatggttgaatttgtttttgggtgttcaatggtgctgtatgcaatcctgtatttttgctcaggtttgtttagaagttcgcacccttctatttgggcttttatctccttccaacatatttgagcctgctccgtctttgttgcccctatataaacttcagacattttctcattgtttgccattgcttcataggatgcaacacatgctagactctgagtctttgcatttttacggccaacctgccaatacacttttgtaaaacggcggtatcctgtatctttatgaatccagccataaacattaccgaaaataaagatttgaatacgatctggaactatgttttcaccagctaatggcccttttgtatgtttgaattgcgtcatccagtaaagaaagcgacgggctttttcatcgtcaaacacgtaaggaaactctcttgttccttctcttttaatatcatttaaaaaccgctgacaagcccatatatgcttttcgcacgcaacaatctcgcccgatatcacatcgcgcgagtaatcaatcataaactgtttaattgtattcatacattactaaactccttttctgctaaagtcttctcccgttcttcctgggttttcgtgatcgcgagcttggcacgtgcagacggtgtgagtccgaaatcattagcagccgatttcatttgatcatagaagtttttctgtcgtttcagtaggggatgctcttctccaatcaacttgaccggcttcccgttttcaccttgaccctctgtatgaatcatgatgccgtcttcctcaataatttttgtaatagaaatgtactgagaataggcattacaataggcggctaacatgctgatatccgcctccgtcataatttccacctcagataaaagagcagcaatccgcttaaattcttttttagccaccttatccagccaggtaggcggtttgatattttcagagcgcattttcaactttttttcatgtttggccctggctgcaagctctttcgtattctttttatttggattgccctgtattaattgaagggctgcggattttgcaggtctcggcatgtttttcacctcatttctattaaaaaaattgcaattttgcgcttgttttttctcaatctcatgctatgatgaaagcaacaacaaaaccagtcatatcaagccctctcggcaaatgtgccgggagggttctttgcgtttttggaaactttgaaaagcggtgtttgtttgcagaagatggggcgccgttcccggggcggttgcttcccaaggattttcataggggggtatccctacttgaccgacttgcttcggtcgccgtgaaccttgttatggcaagcattgcagagactttcaaggtttgaaaagtctaaacgcttggaccagtcctgcttcacctccacaatatgatggaccatgtcggcaggagtgaatcgatgttctctcaagcatcgctggcaaagacgattgtctcgaagcaaaacaagttctcttgttcgtttccaatctgttgatttataaaaacttgttaatgttttgtttcttgaatgtttgttgtaatgtttcgtttcctcctgctggacgtgcttatggtcagggcagtagccctctcgggtaagggccttacacccataggccttgcactcccttaatggtttaggcggcattgtaatcctccttcagtttcaaacacttattgattcagatcttcatttgcttgctcgactaaaggctgcataagtaggccaatacgctcctttaaattgaaatactctgtcaaaaggcgctcggctttctttagcctcttggctttcgcatattggttctttacacctctaatacgcttttggaggactctaatttgtggggtagtcacagaaaacacggccctatgctggcaggcggggcattgaatatacccaatttcaacgccattctcccttttctcctctcgcaataaaactccattaacctcaccgcaatgcttgcatttcgattccatttggatcatctccctcaaataaaaaacgccctctcgtttgggaaagcgcctggtatattctttctaaaccgggcccacactcagaggctctcattggccgccaatcgtttattctgagatttactggacccggtttacagagaacataaaaaagcacccagttgggtgctatatatgatgatgcactgtaaaccatacagtcattgtttaatcccactagttacaacatggtttaccacaatgagtatgagagtgtgtaacaggatcgtaactagaataagtgtgtggatattgatgcacatgctggaaatgcttatgatgcacatttgttatatgctgcggatgaatatgcggcacaattgttttagaaaaagtatgagtttgacaacaattagtcgggtgtacaattggcggcatcacatttggtttgcaatgaaacatgactaagctctcctttcattcattgatcatattcattattaaactatgataaacagtgtatacatgtaccattacaatcacccatatttgtccgatcgagtactatccacagcctaaatcaaaaaaagcatcctcaaaaattttttaaggatacttaaactgaaaggagagaagttattatgatttcgatccatatttgcagcttgtctattcgaattcattcaaaaaaacaagaagcatccttcaggatacctcttgaaaaaaggggtaattctcgatgtattttattttatgcaataaattttaaaaaataaacttgtctactcgcttaataccataatactcgatagtccagtcttggactgtcctcttatcttagttgtacaattcctccttacgctaaacgcttattcaaatttgcgccttacacatacttcggtaggaagccaagcattgtaaggcagcatgtccaaaaaacatacttcatataatctcccgataccaaagccgcaagactagcgcgatccggctcagaatgctcctcccgtttggcttcattcttcatcgccttaatttgagtatccgaattcaccttgataagggaatggtgcgtatcccgttatttcttgataagtaaatcttatcgataaattacgcataaaaattccccctctttatccccccgattatcggaaaaatgtcgggattttgtcgggtttttctcgatgaaaaaagcactcagataattccgagtgctgttgcaatacggcagattgcccgctgctttatttcataataggtatcctttttcatgccgagttccatataaatattgatgtctttcaccctggcagccgtcaggtatttcttttcgataatcaaacgttcttcatcgtccaagctgttttgtaaagcccgttccatctgtttgactttgagttcattaacggtaaatgaatcccggagggaagggaaaatgttaaagccggcagatgaacattcttttttattctctaattggactttgagcgcgcggtaatttttcaattctttgatgactattttccggacggctttttcgtccacatcatcgagaaaagatagctgttcctttgacatcctttccctccattcgttcatttttctttttcccattcctgaatccgtctttctgcaatctccatccagatgaatgaagcggcaagaatgaggatccctataatcacatatatcatgattgcccccctagttttcctccacaatcacaactgcattgctgatcatgattcgttttccgtccaggtcgaatttcaccttattcccatagtcattgacttcaacatcaaatttgcctttgtatgttttgatcttatttccgttctgatcgtagacagttgccgtccgttctaatccattattggatgcgttaaaatccttcaccattctatcccatgactcacaacctgccgccaacgcgacaagcagcagaattacgattgtggcaatagcttttttcattctcatgctccttccactggtcagcccccaatattgggttttgattgattacggctccgccgcctcccatcatttcaccctttgaagtcttttcacatcatcaatattcatttgatagtcagcctctcggacggcagcagcaaatgattcaatccctttttcccaaagaccgtgacgctcaatgatttccgaaaactcttcaacgtcatgctcgcggatcccccagctgtcgggatcttctgcgggcccgtacatagtaacccatttgcttgagtcattcggatccggttcctcccattccgcgcgggtaaaatgacaaagctcatgatcgaccagggcggcgcgctgctctgggttcatcgtcttccaggcttccttattgatgaatacaaaaagcatgtaatcggtcatatggcgctcaaaggccgtgcattttttcgccttcccggcccatttgttgttaccttcccggatgtaaaaaccaatgtgtttcttcatcttttaaatgtgggtgatgcttatcgattaaactttcggccaactgccgcacctcttgtgattcttcaaaacctacaaatgccatggtcattttcccctttcaatcaatttctttttgaatattgcgtctaattcagccaatgaaagctcgtacagctgccggccgtcaggcgttttaaaataccccattttaagcagccgcgctttaagctcgtcctttttcctttcacaataaagggccttcattaattcattcacacaaggcccccctttaacagctcccgggccatataatgaaaatggtgatagatatagtttccggtcgcgctcggattaataaaaacggttgagaaattgtaacggacttcaaacgtttttaagctgccaagcaaagattgcggcttatattgtgagcgatattttccgttcaatattttttggtagccttccagatcctccacaagaagagtgaaggggtgtttggctgcacggatcaattcattttcaaaccgagaacggtccttaatggattgaaccagctcatcaactccatttttccgttcgatagcagcgttcaaatacatgtcccggctaatcccgtattcctcgtttttcgggatcatggcagaatagtcgcccgtcttcatccctttgaatttgatagatacgttctttttgcggagatagtcaagaacatgctggttcttctgctccctcgtatccacaataatgatcatgctgtcgagaatattttttaattctgtatccgaatagttatagtgaataatcgtcatgctttcttccccttaaagtacgacatggccctttcatagatttctaaagagagtttgtccgtttcttcatcctcaaaattcgcaacggagctgttcagatctctccagccgttctcccaaaatagaacaagcaatctcgcggctttgattgccgcatcccactcatgattgaaccagtcgtctatttttggattcatttcttgatctatgcccataaaataattgatgattttatcaatggtctgtttgactttatgatcctgcactgagtattcaccttttaaatactggatgatccgttttttatgtgactgaacaaattccacaagttctggatagacgttctccggatgctcaatataaaggtcatccccatccagaactaaaggtgaacctaaaaaggcaaggtcttcacaaatttgttttgggtgcattggaatcaccactttttaatgctataccgaaaacaaagagcttatttccagttgattttctaagatcatattttaattgtcttaatatttcataaaacgtccgagtaccgataaatgagttttcacgtaaaccaaaatattctctacatgcaacataaagcaatttggcttcaaccttcccaccacaagaacgaatacattggtttttaatgaaatcctcaatagtatctgcgcaattcattttttcacctcttttaaaaaggggttactaaaagggttatcaaattaaaatttcagtaacccactcgaaatccagtcatatcaatggattgagacatttttttgattaaagggttactgaatttttctatttcactattaagctctataaataataattaatatatatatttatttttttatttatttttttcagtagatggaacatagaaaattcagtaacctcagtaacccctaaataatgtaaatctctgataaacccttatatatcaacgtttaaagcttctttctattgattgaagtaatcttatctgggttgctttttgtagtgatttcagtaaccctttcagtaacccgcccatcattattctttaaaaatcttccttcagcatactgatttaatgttattccatgaataaatgtcttgttttttgctccttttgcttttttaaaacctcgaatttctaattgacgataaaaggcacggttttttaactcaacatcatcattttcataacaccaatctttgtattccttatagagttcctttgcttcgatttttgcagccggatgagtgacacacttttcagcaagaaaaggggcgagaatgtccatatcctcccgatagccatctgttgccttcttgatcgcttccggctctccaaggccttccttctgccacttcaaacagccttcaacggcccagcggaggatcccaggcatttccgcggccagtttctgcggcagcttcttgtctactttttcttttgggatcgtgacagtgaacgggattagccggatccggcgccaaataccttcatcgctgcctttcacgatcggtttatggtttgtggtaaagaagactttaaattccggcgtaaactcaaaatattcctggcgcaggaaacgcgccgacatcttttcgccgccggtgatctgcttcaccaacgattcagacagctgctgcccttcttcactctcaacggccgacacaaaccgggcgccgtccagccgggcaatatcattgtttatggcactatcatttttcttcttaatgaaggtgtcactgtttgtctgacggccatagtccccgaacaagtgctgaaccgtattgataaaagttgatttaccattccggccgttcccgaatagaaagaacatgacttgttccgtggtatccccggtcagtgaatagccaattgccttttgcatgaaatcaataatttcatagtttggcgtgccctggtcatctataaaaatactttccaaaaaagttttccagttcgggcagtcggcatcagtttgataagagataggagatattttcgtgaaaagcagatcccgatcatgcggcagaagttcgcctgtttttagatcgatcacaccgttatcgcaattaaaaagatatttgtgggaatccagttcctgcttcctcactgaaaccattggccgaacatctaaaattgtgttcatccgtatgttgcggcgctcgcatttcttcgcccaatcgttcagctgcttttttcggaatttgtcttctgtggccttagcctcgccgtacaacgcccgtaatgtcttagcggtaatggcttcaatttttcgtttgctgtcttcttcccatcgcttgccgttccagatcagccagtcaagctcgttacaatatcgaatattctttccgtggtagtagacaactcgttccgcgttgccgagctccgtcaaatgaaacgccggcggagtgtcaatgatctcttcggtatcctcaacttgagaattttcgggatgggaaatatatacttcatacggctgttcctgctgttcttccagcaaatcagaaattgtcgtatgagtagaataaacggccgcggcaatggtcatttctccatatgtagcgccatcggatgaatgctgtcgatcccatttctcccggaacaaacctgattcgcgaaacattgaatccatttttgcgggatccttatccgtccagaatgccaaatgattacacaaagccatatctgtggccgagtgatcatcatttatcagatgaccgttaaacagatcctgaatgctcttcccgttcttgctgttgaacatcctttcccatatctccttattagagaggttgctcatatcacgggatgaagcagcagggagtttggaaggtttcgattcttcttttttgtccttcaaatatttctcgaaaagctctttgagctcgtccgttcgttcttcaacggccccgatcccgagactattgccggtaaaggtgaaataacggccgtggcggtatacttccagcccaagttcaggatttttcctacctgtgcccggcccccgcaatgggatcttaccttttgtgataatgtggacgcccttgccgctgggtgaatattcggtgtagctgccaatcgcctgaacaattttctcagcgaacggggacaagacaccatcctccacacaatgatctatgtctatgccgatgaacggatcatcttttgaaagcatgaagccgatcccgtcataatctcgatcgttataaaatttcaaaacggtcgggaacgtcgaccaggttcttttattactggattgagccatgctgccatcaatctggtagggcaattttgttttcttaccgtcacgttcttcggaacgccataaaatccactgaggggcgttttttaactcttgcggtatattcttaaattcgtacatgtgataactcccctttaaaaacgagggagctatacactccctcaaatgtgttttttatgatcaaaacggtacatcatcgtcactgatattaattggttcggtttccggtgctggcgcttctgacggcttaaacgcttttacttccggatatttcttgccgttatgctctctttccccgacaagcaggcgaaccggtttattcagaaacgccttggcccattcgatatgatccttaaattgcattccgtttggaaaacccgcggcctttgatgcttggtgaaatctccacattgcattttccgtaacggtgaagttatcgtataggattttttggccctggcatggctgttcaacgtcagaacgaatttcataatctacgacaaggcgctcatttccggatgcagccgttttggcttcaaagttgataactgtcgcttcgtattctcctggtttaatcggttcaaaagcttcacctttgctgtggtctactgtaaacattatttttcctccttagtctttaaagcttgtaatctatcaagtgcggcagatgccaacttaatagtccattgatcaagttttttatttgctttgatctgaaattcttcaatcatctgggcggctgtttcgttgccggcgacgattgttttaatttcatcaatcaatcgaatccgttcggcttcttcctctgctttcacgtcaataccgagctcaagccattggtaaagcttgcggccgacttctggattgagtttaaaagaagagccttcaaacatgcgggtattatctttggaagtttccgccaaatgatcaataccaatattgaaattgagcatgaattcatactccatttcgtctttttgcacaggcttggtcccgaccttacgcggcgccattttcccctcactgttcggctcaacaacgtactcagttttggtccgaagcgtcgccagaatgtggacgtcattttgcgttaacgtttttattaatttcgtagtttcgggcgcaagtttaccccagttttgaaatgagttaccttgcatttccccatgtttttcaacaatgccgccttcccccgcccaattgtgggaaagcgagtcaattatgacaacttctgcaccggcttccttaattgcttcaagagccatttgataccgttctgtggtataaggcggtgtaaaatcgatgtgcttgaagctgccaatccgtacatcatcaaattgcaagtttgcatacagtttggcgcgacggtgctcagtatccacaacaccaatctttgaccagacttccttatcacttgcatccgggtatgcttcccgcatcattccgtaagcgacaagcagggcaccggcagtctttccggatccactcggtcctataaagccgacaattgccttttccttttcacgctgtgcgtttgtgacttgaaacatctattacacctccactttgaagcttgtggaggcaggttctatttctacccccggaacagcttgtccattttcatcaacgacaacctttttgccgtccacctctttgatagacagagattttttaaagtcgccccatttgacatcttctttgataaattcagtgagaccagcctctttcacatgcttgagaagctgatccttatcggctggcttaggctgctctttaattgtgcggctttttgacttaccgtaaggagtggaaagtgtttttgcttttggatcctgatcgagctgctttgagtgataaacgctgaccaagttttcaaagaacgcaagattgtccgcaacaggtttgagctcctgcgtttcccattcatcgatccgctgcctttcggttgccgccaaagacttaatttctttttcctgtgtctttaaagcagcaattttccggaaagcccaatttaggctattcatatccgtgatctcaaactgtggacgttcctcctgcggcgcttcatttttatttgaaatttcacttaattcaaatgcctgtaatggattcatgtatatacctcctgtattgattttgtattaaacaccatttaaaatgatgttgtgagttttgtttttagtcgcctctgccaaggcggcttttttattcataagctgacggataaaatgcagtcatttgaattttcctgttaatttcagtctcgtaccaaaagctattatcataggaacgctgattaatctctgtgttcaaattttcagcggcatctttcacgttttgaagagctgccttttcatttttacagtgatagacaatgtcaatcctcccaccatttctcaatgcatattcgacaaggtgcaatactgagtcaatctgtttttgatccattttcatcctccttttctacctcgtctttcaaatattccaaaggatatccgtaacggttgatctccgtgaccattggatgttcaatattcattgaaacgatctccttacagttgaaacgtttaatcccctgttcgcaaatttggacgcgatttcgtgaagccgaacaacctgttccgggtgctccatccgtttaagatccttgcaatttaaaatgattgttgccgcaatttctacacatccttcaaaatcatgttcctcgatcgcggcaggcaattccgcaataagatctcgcgttgaaatgaacagcctttccgccttttcgcggtcagtttttagaaatcggtttaggttcatacccgtaccacctttctttattggtataatgttcctaccatctaagataggagtgtatttatttggagatctcaacaattctgtcaataattgcagtagtcatttctttatttacattggctgttcacttactaaaatacttctctacttttccgaaactagaaataaatgtgttagatgcttttttattcaaagtcatcaaaggtaacgatcgctacgggaaaccttacagattaatacttgagctcagtctcgtgaataaaagcgaacaacctatatccatttacgaataccaatttacctcttcaaaatttgaggaccctgtcttttacaagggacatcatagacctggaaaaaaatatattatttctcaaattggtgatgaagaagcatcaattgaaatagccgagtttaaaaatttaaaaccacctgtaaatttgagcccttactcttcagaatatggactaataatatttttgacgattccttacttgagtaatacaacgaacgaaattgatggagaattaacaattaaaacatcaagaaaagactatacaattcctgtaaaagcaagaagaagcgattttataaaagcgacagaattaatgcagtaagagacagaatgacacaaatactactgactataattccaattaaatgaaatcttctgctatccatatgatcaccccgaaccttttcaacctctgttgccgcaggggttgatttattttgtttttccattttcctacctccttttgatttttagatatgcttcttcacaaatgcttgataaatcttcataaaacgttccgcctcgcttaaagcaagccattcttttgttttgatcttcattttctcacctcccttcaatgggtcataacatctatagcaatgtcgtttttatcagcgaattcttcaaacagacttttttgtcctgaggctcttcctaaatcactaactgtcgatactaaggtaaccatgaataaagtgatatccggattctgataatcccaaaggaaatcgaatacctcttcttccgttcctatgcaattgtctattcctttttctttgacagcatgcatggtactgaaatagtctttcattccaaacttttcaccatcatactgcttacggatggggaacatctgcatcaattctccgggtgtaagctttcctattacggtttgaatgaactcaattaaacgcagctttacttctaggaaacggcgtgatctagccttctccaggttgatcatcttgattccagcaaacgcgattttcttgaaatcgtctgtatcaatttgattagttctttgtatttttctcgcactctcaattaccgctttttgaaacatcctgtggtagattgagtagtggtctggctttcgagtaccctcgatcactttgagttgtgttttcatgaaaatcctcctcatttgcttagtccgcaggggcatcttcctcttttactaggaatgctagtcatcttcccctacaatcacaatgtgatctaatgcgaagcggagacaggaatcaattaatttatgtaacttgatacctgtttctgcacttaaatcttttaactgttgatgtgtatctgtactaatcaccacaactttttgcgctttttcgggctgttcacgttttagttctagtgtgcatgtcatgataaaccctcctcattttttaggtctgcatgatatttaattgccattggtattttgatgtgatggtcagtgtatgtcgtttcattcccttgagctgttgctttttttgagtaacagctatccacacttcttcaatcttgaaatagatcattcagagtgcagccaaacaatttggtaagcgcctttgcttctcttaaagtaaattcctttttcccacgttccttttcatggtaggtctgtggatgaataccgatttttcgagcgacatctttttgatacaatccacgttctcgacgagcaacgtagagtttatgtatcatgacgcctcacccacaccgtacttaatggccatttccttcacgatcgctagataaatttcagtcaagcgagcatcatcgccaataacgtccattttgtttaccttgtctatttttgacttaggcacaccgtttaaggccatttcggatttcttattcgtaagcctaatggataaacgacacctcgctctatcttccaacaattgataactttctttcctaacatctgcataggcttggaaaccgccttttgatagcgcaatagcattgatgatcttgttcactttctttttccattcagtaggattaagcgaaagaacttctttaatgttgtcttgcttcttttcaacagcatcaaggcgtttgtcttgttcctgctgctttagttgtgtacgggctactgaatcaaaaatttgcttgaacatttgtagttcagggcttaactgggatgtatcaatttgagtttgcttgacgttgtaatactcatccaaaagcatttcataagcgtcccaggcttgatcggtatttagtgacttcgcatgaagccatgcacctttttccgtccaaaggtagagcgtttgggcgttttttgaaccatcctcaatttgcgtatggttgataaaatcccgtttttccttcccttgcaaagagtaaaaatgtttcccttctttaaagcgatttatgttacgtttaaaattctcggagatccgacggttattcgtcccatagctttctgccaactgggctgttgttaaaacacgttggttattcttttcaataattgatagattcattgttttctcctttctatctccctttctgctaaactattgattgaagggaggtgtatcagtaatgagtgaaacaggtgaagagttacataatcatccagatgccttcgattatttaactcctggcgaacaaaaacatttaactagttggattgagactaatctcaaacccaccaaaacctttaatgaccgtcgcacctcttatggtttgaaacatttgtttgaagacactggtggcttctatataggtaacggcgcatttaaaggtgcgatgataaagtgcgggttcaaagcgaaagatgaatcagcacttaattgggtatttaacgtatccgaaagatcggttaatcagactcgtattcgagcaaatcgtttaaagtaacctttacgcactcccattcttcgaaggcaaggacgccttgttcttttaacaggtttgctaaatacgtcttacctgtaggtgcctgcttccccgttattaagatgggagtgccttcttttatagcagttccaatttcttgtttttgtaccctactcaaccaaccaggtaagtttaattcagattcagctaagagcttctcgtcctttaccttaaactgtctatttatgctcatttttgatttgcctcctacgaaattttcgttgtttccaaatcggaaacttttttagcaaaaaaaatatcaattttttctctttttattccaagtctattagatattagggagaaatcttccactgtcaaagctattttcccattctcttttttggaatacgtacctttagaaatgccaaggaagtcagccatgtcttgcacagttagacctctggcaattctttctgctttcaaacgattgtaattaaacttcattttttcacccactttcgtttgttgttaggtccataataatatcaagtttcctaattgtcaactattagctcaaaaaaacacaaaaaatatttttaaccctaattattgtttccttaaaggaaacatgttattatctgattgaaaggaggtgctagcatgagaaattcaattgaaatagcacagtatataaaaaagataagggaaagaaagggtctatctgcggtagaacttgccaatagggttggtgttacgaaagggactatttcgagatacgaaagtggaacaagaaaaattccgatggatgacatacctaaattcgcaagtgttttagatatttctcctgttgacattttgattgaatcgagagatgaaccagtagagatcaactcaaccaaatacccatactacccgataggcatatccgccggccttcctttatgcatagacagcatagatgaaaacaatgtggagtatatctcaataccggacaaccttatgggcaaatgggcaggtaggaaagacatctttatgatgcggattaatggagatagcatgaataggattatgccccacgactcactgattgcagtaaggcctgtaccattatccaatctacgcgatggagatatagtggtttacagtgacggcggggattatgctgtcaagagattttaccgcagggaagataaagttatatttaggcctgattcttccgatttaagttttacggattacgtaacatctgctgataacatcgatttaagaattcacggaaaagtagttctatatatcgcagaattagattaagttgttagcgctaaaaatttaatcacaggcgggacgatcacccgcctttttttaaaggagtgaatttagtatgcctgtctataaagacaaggaaaggggaacatattattttatcatatcctatacaaacagaaatggagaatacaaacagataaaaagaagaggatttaaatcaagcggagaagcgaagagggctgaagcagaaacccttttacgactagaaactgacgacggagaaaatgaagataatccaacttttgaatttgtcgcaaaagaatacttgaaatggtacaaaaaaagaagaaaggcatcatcatatttaaaaacaagtagcattataaatactcacttgataccaaggttcgggagcaagaaaattaacaacattcgttcaagggacataatgcgttttcagaatgatttgcttgatagatatgccgttgcgcacgtcaaaaagatacatcaagttttatcggctgtatttaactttgcgattaaacaagagtacacaaaagataatccagcacgtttagcaggaaatgtggatatagaagaagataaacacatcaattattggacgttagacgagtttaaagcgtttattcaacacgtagatgatcagttatattatgcactttttatgacactctattatagcggtatgcgaaagggagagttattagctctcacatggggagatattgattttgacagtaacactataaatatcgataagaccgtttataaccgaatagtgactaaaccaaaaacaacatcgtctatacgaaaaatcatgatgcctaaacacgtaatgaggttattagctcaattaaaagcaaaaaccaagacaaaaatgacatatgtagtatttggggaatttcatgaccacatttcaactacaacactagatagaaaatacgctgaatacgttaaggcggcaaaggttaaaaaaattcgtctacatgatttccgccattcacatgctagctatttaattaacaggaacacaatcccatctgtcgtggcaaaaaggctcggtcacaaggatgtgggcacaacactcaacatatacagccatttatatccgagcacagaaaaagaagccgtcctcaaaatggaagacgacttcaagactgctgaaattattcaccttaaagaagcttgatactctagcgcgtaaaaattcttaccacaattcttaccacggtttcataaaccctatcaaatcaaccttaaaactcaaaagatggagacggtgggagtcgaacccacgtccagaaacgtcgattgcttcagcgtctacgagcgtagccctgcatatttagtttcgctcatcttcgtgcctgcgggcgggccctcggagagctagtctgatgagtctcttcctgcgccctcagacgggggcgcaagcgtagcctacttcgttatgggctcttaaccggcacataggcgatgcgggcaagagctcgctgcgctaattaggcagctagtgctaagttctggttagatttgccagttatatttaggtgcgtttttacgagatcgcctctcggctcgcagctcaagctcgatccgtccctgtcgaatccgtaacgtccccttggatgaaaaggaagccggataactggctgcatcactattataacaagatcacgcgtcaattccaaatggtaatgtctgtgatcacgttcatataggataacatgagttctggctttagatcaagcctttttgcctgtcgcggaacgctctttcgatttcgcgtttggcgtctttgcgcttcaagtcttcgcgtttgtcgaacttcttcttcccttttccgagaccgagcagcacttttgcgaagccgttcttcaaataaatcttgagcggtacgagcgaatatccctgctctttcgtcaaaccgatcaatttgttgatctgcttgcggtgcatcaaaagctttctcgttcgcaacggatcatggttgtagcggttcccctgctcatacgggctgatgtgcatattgtggaggaacacttctccgcgttcaattttggcaaacgcgtcctttaaattcacccgaccggcgcgaatggacttgatttccgttccttgaagcacgatgcctgtttcgtatgtttcttctatgaaataatcgtgatttgcttttttattttgggaaacaaccttcccttctccctttggcatacggcaacctcctcccgccttcaatctcactaaagggcggcgaatacgtattattctatcaaatgaacgttcgtcttacaatttcgccgccctttttttgacgtgtgccgtctattttttctttttcttgcgtttttgtttcggcgcgttttgaaaaccgcgttttttctttacttttttctttttcggcttggtgaaccattcccctttgtcagccgatggagcctctctttttgaagcctttttctgctttggctccggcttctgccggcggcgggagcctttcatgccgacgatttcaaaatcgatgttccgctcgtctttattgacgtcaacgacgcggaccgtaatctcatcgccgatccggtacacgttgcccgtgcgctcgccgatcatcgcgtagtgctgttcatcataacggtagaaatcatccgtcataaagctgacgtggacaagcccttcgatcgtgttcggcagctcgacgaacatgccgaagttcgtgacggagctgatgacgccgtcaaattcttcaccgatcttatccagcataaattcggtttttttcagatcgtccgtttcccgctccgcatctacggcattgcgttccatatttgacgtatgctcggcgatctcaggcagtttctcggcccatttttcccttgtcgcttcgtctgtcttgccctgaatcaaataggtcctgatcagtctgtggacgattaagtcaggatagcggcgaatcggagacgtgaaatgcgtgtagaattcagtcgacaagccgaagtgccccaggctttgcggatcgtatttcgcctgtttcatcgacctgagcataaccgttgaaattacggcttcttcaggacgatccctgacttcttcaagcacgctttgcagcgctttcggatggatacttcccgccgttcctttgacgacatagccgaatgtcgtaacgaactccaaaaatctctgcagcttttcctgatctggatcttcgtgaatccggtaaataaacggaacattcatccaatgaaagtgctcagcgaccgtttcattggcgacaagcataaattcttcaatcagcttttcagcagtcgaccgttctctcaagacgacgtccttcgcttttccttcttcgtcgacgagaaccttcgcttccttaaagtcaaagtcgacggctccgcgttccatccgcttgccgcgcagaatcgcagccaagtcttccatgtctttaaacatcgggacaagggcctcatacttctgtttcagctcttcatcatcatcgactaaaattttgttcacatcagaataagtcatccgctcggtcgttttaatgacgctttgaaaaatttcgtgctcgacgacttgcccttgaggattaatgagcatttcgcatgacattgtcagcctgtcgaccttcggattcaaggagcagattccatttgacagcctgtgcgggatcatcggaatcacccggtcgacaaggtagacgctcgtgccgcgttcatacgcttcctggtcaatcggagatccttccgttacataatggctgacgtcggcaatgtggacgccgagtttataatggccgtttttgagttttgtgacggtaacggcatcgtccaagtctttggcatctgcgccgtcgatcgtgacgatcgtttgatcgcgcagatcccgtctgccttcaagatctttctcatcgattgtatcaggcgtattgccggcctgttccatcgcctcagccggaaagtctcccgggaggccgtgcttatgaataatcgaaagaatgtcgatgccgggatcgtttttatgaccgagaatctcgatgacttccccttctgcactcatccggccttcaggatagcttgtcaggcggacgacgactttatgaccctcgacggcgccgtttttggcgtgcttcggaataaagatgtcattcgtgatttttttatcgtcgggaatgacgaagccgaagtttttcgtctctgtgtatgtgccgacaatcttctgaatgttgcgctcgatgatgcggatgatggccccttctttttttgtaccgccggattctgtgctcaggcggacgagcacggtatctccgttcattgctgtgttcagctcagacggcggaatgaagacatcgtcaagcgaggagtcttcgggaaggacaaacgcgaagcctttcgcgtgcgccgacaccttccctttgatcagattcattttttcgggcaaaccgtagcggttgcttctcgttctgacgacaagccctttttcttcaagggttacaagagctttgacgagctctttgtattcgtccgaatcggtgatttccagcatctcttccagttcctgaactgtaagaggtttatatgcttcttctttcataaaggagagaagcttatccataaattcttctttttccactaatcagacctccttatgtctgccaatccaacgtttctaaaaattgatacacatccttgtgcagtgtttcgcgttctttatccaatgtgatggcatgacctgattcttcataccatttcagctgcttatcatccgtttcaacttcattgtagatgatgtttgcgctatccgtattaatcatatgatcgtggcgcgcctgcacgacaaatgtaggcgaatagatcatgtccacatgctctctgacatcggcaatcaaatcctgcagtgctttcaacgtgttcatcggcgtttttttgaattcttccatctcagcgttaatctgctccgctgtcttgccttcaaatttcttataattgcgggcataatcaagcacaccctcgtacatcgtctcttcgcttttgatgtacatcggcgcgcacattggaacaattccctttatgggtacagtgtaacccaatttcaatgaaaaaacccctccgagagacagtccgcaagcggcgatttgttcatatccttccgatttcagatattcatatccgtccatgacgtctttccaccagtcttccggtcctgtggagagaagttcttctggaggcacgccgtggcctttatattggggcgcatggcatgtgtagcctttttcattcaaatatcttccgagcattctaacgtccgccgtgttgcccgtaaatccgtgcagcagcaggacggctttttttccgcctttaaatgtgaaaggttgtggtttgacaattttcatgattcactgtctccttttcatatgtattcttccacgtttagtcttgaaacaaactttatcaatcggccggccccttcagacaaagaccggcaaataggaaaaaggcctgacttgaacatcagacctcatgcttcattgtcttatacaaagtaagcaagcgcaatcgttaagaaaaagaaaagcacggttaaaacgaccgtcatccggtgaagaatcaaatcaagtcctcttgctttctgctttccgaaaagctgctcggctccgccggaaatcgcgcctgataatccggcgcttttgccggattgcagtaaaacgacaacgattaatacgatacttacaatcactaataagaccgttaaaaatgcggccataacctacacctccagacaaactggctgacaatagttttattttacatgaaaagcaagcgcatgtcacgagcgtttcgaacagctttttttattttttcccagcgccggaataaggtatacaaaaaaagagagcggctctgctccctttcctgcggaatatgtaatcacatttatttcttttctgacagtgccgccatcatatcttccaggagcatttccgctccgcgcgggctgagtacgattttgccgcccgcatacgttttatttttcgtggtgatgtcgccggtcatcaaacatgccatgtttgcggcgtattttgtcaaaatgatgttttcgccgtcggtatatatttcgagcgggtccttttcattgatattcagcaccctgcgcatttcgaccgggagaacgactctgccgagctcatcgattctccggacaatcccggtatttttcacgtttgaaaagcctccttttctcctttctttattgacttttgtcaacatctttataataaaagagatcttcaaattttttgttgaaatactgaatcatctttccgatcacaagttgtccgggcctcctttcgccatttaaaactctgctgagtgtcgccggggatacgccgatttcaatggcaagctgatttaaggagagattgtgttcaatcatgtactggagaacaaaatctcttttgatatgaatcttttttaccatgattactcccctttctaatctcttatgtttctttttatctacattgaacatatacgatttgttaacttttgtcaatacttttaccatccatatgtttcctataggcaatattcgtactaaaatattttataataagagattgcgaggttttggccatgacgaactttggacaccatttacgacaattaagggaacggaaaaaactgaccgtcaatcaactggcgatgtattccggcgtcagttcggcaggcatttcgcgaatcgaaaacggaaagcgcggcgtgccgaagccggcgacgatcagaaaactggcggacgctttgaaagtcccgtatgaggaactgatggcatctgcaggctatatcagcgcgtctacagtccaggaagcaagaagcagctatgattccatttacgacatcgtgtcacagtacgatttagaggacctttctctgtttgacagcgaaaagtggaaggtgctttcaaaaaaagacatcgaaaacctggacaaatatttcgactttctcgtgcaggaagcaagcagccgaaacaaaaactgaatacttctccgcggcacactctcctctctatcattttcgtctgtttacgatcctgctgttattttatcccttatgttaacttttgtcaatatttttcctgtctaagtatttcctatagtcaacatttgtattaaaatgttcatatcatgaatttgcgggggggggatggcgatgacaaggttcggcgagcggctcaaagagctgagggaacaaagaagcctgtcggttaatcagcttgccatgtatgccggtgtgagcgccgcagccatttccagaatcgaaaacggccaccgcggcgttcccaagcccgcgacgatcagaaaattggccgaggctctgaaaatgccgtacgagcagctcatggatattgccggttatatgagagctgacgagattcgcgaacagccgcgcggctatgtcacgatgcaggagatcgcggccaagcacggcgtcgaagacctgtggctgtttaaacccgagaaatgggactgtttgtcccgcgaagacctgctcaacctcgaacagtattttcattttttggttaatgaagcgaagaagcgccaatcataaaaagccgaatttcccttttaggagaagttcggcttttttcggctgccttaagcggcatccggattcggcgtcttgcctttatgatgcttaacggggctcagcgcacgctcgagccatcccatgaacagatcggcgatgatcgccatcagcgccgtcgggatcgcgcctgctagaatgatcgctgttccgttggtcgcgtttgatcccctgacaatgatatccccgaggccgcctgcgccgacaaacgtgccgatggccgtaatgccgatcgcgatgacgagcgcggttctgagccccgccataataaccgacaaggcgaggggaagctccaccatccggagcacttgaaatttcgtcatgcccatcgccttccctgattcaagataggcatgctcgatgctggcgattcccgtatatgtgtttcgaatgatcggcaacagcgaatacaaaaacaatgaaagaatcaccgtgtttgcgccgagccccatgacaagcatcaagacggcgagcatcgccagcgccggaaccgtttgaatgacattagtgatggaaaagacccatttgctgattttacggtatctggcgatgaaaatgccggccgggatgccgacgacggcggcgaacaatacgccgtatgccgacattaaaaagtggcggtaaaattcccccagcacatagccgccgttttgcgcgtaatacgtccaaagctgctgcagcacttccatttgtcatcccctccttttactcaaaataattgtgcttctttaaaaactcggccgcgacgacagaaggctctttcagctttccatcgacttcgtaattgagctcctgcatcgtttcggtgtcgatttttccaatcagtttattgatggtctcttcaagctccggatgctccttcagcactttttccggcacgaccggcgaacagtcatacggcgggaaaaagcgtttatcgtcttttaacagctttaaatcataggctttgatcctgccgtctgttgaataggcaagaacgatatccattttgccgtttttgacggcgtcataaacgagtccgatctgcattggaaaggtcgagccaaatgaaaacccgtattcctgtttaaatcccggatatccgtcgccttttcgtttcagccatgcattgtcaacgccaagcttcagttgatccgcgtcttttttcagatcggatatggtttcatagttccctttttcagcgagttctttcgtgactgtaaaagcgtacgtattgtcaaatccgtaagaatcgaaccatttgtagttgaatttcttttgaaagtcctgctgtacgatgcggagcgcttttttcgggtctttctccgcttcccttccaagcgtgcttgtcaggtcagttcccgaatagcgcgtcgcagaaatgtcgatgtctccgccgagcatggcctggtgctgcacatagtttgagccgaggtttttgaccagcaccgtattgagatccgtatcatgctcgatcaaaagcgagatcatattggcaagaatttcggattcggtcaggttttgcgctccgattttgatcgttttatcggaagccccgccaaggcccggcagcgcacagccgctgatcaaaagcgagaggaccagcatgacggcgccgagccgtctcagtttttttgtttgcataagagccaactccttatgatacttccttcatcccttttaatccttgaggcgtgactttgtcttcggttttcgacagaatatagtcgatcacgatggccagtatcgtaaccggcaccgctccggcgataatgtactcaggctggtacaggttgagcccgataaaaatatagtcgccgagaccgccgccgccgataaaagccgaaagcgtcgcccagccgattaagtaaacggtggacgtccggatgcctgccatgatcaccggcaccgatagcggcagctcgaccaggcggatttgttcccatgcagtcataccgattccctttcctgactcaagcaaattttgattgacgccttttacgcccgtgtaagtgtttctcagaatcggtaggactgaatagaaaaacagcgcgacaatcgccggaatctttcccactccgagaagcgggataaaaaacgccaggatcgccaaactcggcagcgtctgaatgatgttgacaacgccgatcacgacgccggctccttttttcattctcgttaaaacgacaccgagcggaaccgcgaaaatgatgccgagcagaaccgcgaaaatggatatatataagtgctcccatgttttataaagcatttccccgccgttgtgctgaagaaattggacaagctgattcatgattgatgcacctccctgcatttaacgttgaacaagggtttcttcatctccccaaatcgagtcgtacacgatatcgacaaggtttgcccttgtgacaatcccgacaaggcggccctcttcatcaagaacgggaacatatttgaatccccttttcaaaattttccggacggtatccctgatgagcgttcctttttgaacggagtaaacattctcattgacaacctccccgactgtgacggattttttccggttctgatcgatgatttcaacatcgatatatccttttaagacattgtgttcgtccacgacgagcagtgaatcgacgcggcgttccctcatcacttgaattgcttcagtcaggtttttttcgctcgtaatcgtgaccggattcgggttcattacttgttcgacatgctcgatgtcaggacgggactgaagaagcctctcttttccgataaattcctcaacgaattcatccgccggtttccgcaaaatgtcgtcaggcgatccgacttgcacgatctcgccggcgcgaaggatgacgattctgtcagcaagcttaatcgcttcatccatatcgtgggttacaaagacaatcgttttgtccagcgatttctgaagctttttgaactcttcctgaagcgaatcacgggtaatcgggtccagcgctccgaacggttcatccattaaaatgaggggcggctctgccgcaagcgcccgcagcacgccgattctctgctgctgtccgccgcttagttcatgagggtagcggttcaaatattccggccccatatcaacgagctgcagcagttcctccgcccgcttctttcgcttttcttccggccatttcaaaagcctcggaacgagcgtgatattctgctgaatcgtcatatggggaaagagtccgatttgctgaatgacatagccgattttccggcgcagctccaccgggtcctgatccattatgttttctccgtcgatgtaaatgcttcctgaagtcggttcaatcaagcggttgatcattttcatcgtcgttgttttcccgcagccgctcggtccgataaagacgataaattcaccttttgctatatcaaggttaatgtttttgaccgctttttttccgcctttataaacctttgatacattctctagcttcagcaaaacgcacacctccaactgttttttaaaaatttcaacatctcattcattataagatacactttgtaaaataaaaagtttacaaagtgttcaaattatatatataagacataaaaaaatatattcatggcatcaatttgccggttattcttaaaattgcggctgatttctttgtttttctgtcgttttagtgttttcaaccgctaacaaaattatgatatattgacaataaaattggctgcccgaagggatgatgagctttggaggaaaacgctttaaaagtgattgaacaagcggaagaacatttcatagaaaaaatcgccgaaaatatgaatacatacggtctatcatcaactgtcggccgcgtgctcgggatcatctatatgaacagaaagccgatgaccttaaatgaactgtcagaagaaacgggcatgagcaaaacgagaatgagccaggtcgtccgcgaaatgatcgatttaaatatagctgaaaaagtttttgaaaaaggcgtccgcaaagatctgtacgatgtcgaacaagactattatcaaacgtttatttcattgtttacggccaactggagcaaagtcgccaaaaagaacaggatgattgggaaaaaaatcagaaaagagctgttggaggcgctcgaggaagaaggccttacgcctgaaaccgaagctaaaatcaacgagctgctggctgaaacaaaacaatggatcgattactgcgagtggcttgacaatctgatcgcgtttttggaaagcgaagagatcttcaagcatgtgccaaaaccttcataaacaaaaaaagctgcgaagactaagcagcttttttgcatttcctcaattatcccgccaacaccggaaacatccctttcaatcccgttccgatcatgccgaccgccacgacagccaaaatcaggcccatcagccgggtgatcacgttcatctccgtctggcccaatttgttgctgatcagcgtagaataatgaaaggccgcaaacgtcagcaggaggacggcggcgatgccgatgatcattccgccaaaatgcaccagactgcggcttccggccgaaaggctcatcaccgtcgcaatcgttcctggccccgaaatgatcggaatgctgagcggcgtcaccgatatatcctccttttccttgctctcgcgatgctcagcatgatgcagcgactgaacatgggactgctttgcattcagcaggttgtaggcaattccgaatataaatatgccgccggcaattcgcagcgcatggatgttgatgtcaaaaagcctgaagataaactctccgaatatgagaaacgcgatcaggatcagaaacgataaaaccgcggcctttctcgccaatgcggtgcgttctttcgcttcgtagccttctgtgagcgctaaaaagatcggaacattgccgatcggatttgtgacggcgaacaatgatacaaaaacgtggatgataaaagcaaacacggttaaagccactccttcctctgtataaaaatacgggtaatcgatttttacctccgacgctgaccgcttaaactttcaaaaaacaatgacaccttcctgcactttcatttataatgaacctttataggccaaaataactattttaaaggagattttattttcatgacatgttcaaagtgcggccatcaaacagatggcggaaaattttgcgagcagtgcgggtcaagtttggccggcggcagtgatggcggaaaaggagcagctgaaacgccgcaggcagctagatatgcggaggcggcgaaacaagcgtcttccatgtatttttcctattgtttaaaggtgctgaaacgaccgtttatcgaaatgaaaaacgccggagaacagcacgtcctcaacagcatcaccacaatggtgatatttgcgctttcggtgccgctgatgttttatttcggcctcaaaggcttctttgacgccatgggggactattccggagtattcggccgctcctacgcaatgccgacattttttgatatcgtcgtaaagcccgctgttacctttgctatttatattttcttattatttgtttttacatacgcaggcgtgcgcattcggggtgtgcaagcggcatttaaggaagtgctcgggcggttcggagcggtgcttattcctttcgtcgcccttctgctcgccgctttgcttttatcattcatgcaaacgggtttgtttatatatgttcttttctttgccctttgcggcatcgcctttttaattccgccggctgtcatctcgagctatcacgaaaaagcggaaggcgctgttgatacgatttacgcgacgctgatcgtctatttgctgacatttatgtcggtgcggatcatgggagatttgtttcttgaatatatcggaaggatcggaggctctatattagggcggctgttttagtgaattgaaaagcctttttccattgaggaaaagggctttttttttattctattgacgttaagagcaatctgccgtcctcgatggcggcgtgatatgtccaatgatacgtttttaactgttcttttccgcctttgataatattaattttctccgttgtcttaatcgttgcctcccgcccgttttgcttccagctgtttacgctgaattggacgacttcctcctctgtcccgctgttgtacagtttagcgaccagtttcttttgatcgttgtacagcggacttccttctttcaagctgtcgcggacgaggccgaaatcgtttgtgttgatggcgtcttgtagcctgtataaatacgcttcaatggcgaaagcaaccttttggtcggtgagctcttcgcctgctgatgcattgttcatggcccctttcgctgaggcccatgccgatgtgtattccttcggattgtcatttttgatttctttttgatgctcgatatcgataacggcttcaggatcgcttttttcgatgagccactttttcttgccttcggaatagaccaatgtgtacgtatatccgctatcgttttctttcagtttaggcgcaatgtagtcgtcataataggccgatttgtgcttttcaatccctttgagctctgttttccattgcccgtcttctttgtatagccggaacgaatcaagatcaaatacagtagataagtaggtgcctttatagtaggtgctgctgcttttcagcccgtccgtgacctctttcaggcggttttgataagacggggcggccattgtcatgccgctgacattgccgcttgcaaaggcctttgctgcttcctttgtatggttgacgacagcggtcatcatgtcatccataaaccctttgtctgatgcaagattgacttcgatttcttcaccttcaatcggcgttttttcgcttttcagcttcccccacggaaattgcgcctcaacctgagcagacattgaaccgtcagtcagcacaggtccgaattcagttcctttgaatggattgatcttcatctcctgatcattgatccagagcgttcctttcaagttttcatagccttcttcaaagacaagctttgccatgtgcccgttaaggtccgcattaaccttcacatcaccttggagggcggtgaccttcaagatcggcgattccgcttttcagctttgccttcacctcgtaagtaccggggacaaacgggccgatttttttctcgaagttttctttttctgttgtgatgacctttttgccgttaacaaacaggccggtatctttatagtttgtcttaaccgttaagtagacaggctccgtgttcaagacatagcggtcatagatccaaaaacgcctgccctttttttcgatcgtcatcaatggatggccggcaccgctttttaaggatgtgatcaattctttttcttcatccgggtgttctttcaagtaatccaagagcggcttgacgtttttctccgtgacagccagatccacgtctgatgattgaagcagttttgctgctttcttggcatctttctgatcgagggcggcttcaaaatcggaaatcagtttttcctttgatgtgagtgcttcaccggttttatagccggcaaacaataaaatcaagcaggccgcgattgccgccatgatgatgattctttttcgtgtcatcgcacgctgataccttgccgccgggtcggaagctcgttcctcgtccgcccgcgcgccgcaatgcttgcaatacagcgcattttttgttcgttcccttccacattccttgcaaaaatccatgactttcctcccatcaaacaaaaacacaattagtcattttatactatatttatcgtaagaagggatttaatattaaggccgcatcaaaaaaagccaaacgaatgcgctgatccgtttggcttttttgatcattttaaaaagtatttttcaatatcatcaagcatcaggtttgctgcaaggacgccccctgctgtattccagatggcatcgctcactttatggacgtttccttttttggagacgtttaagtttttaaagagcggatcattgacatagtctttctcaatggcgcttgctttgtcatcgcctgtctcatacgtgtaataaaaaagcacgtccccgtccatatcaggaatttgttcctttgtcacttccatttgtccgagatcgttggcttcctggcctttaggccttgcaaaaccgagctgatccaaaatcgttccggcaaatgatcctttgtgatagatgcgggtatcagcatctgtaaagcggacgagagagactttttgtttcactttatcgcctagtttttcatgaatgtcttcaacgcgcttgtcaaagtcagcgatgactttttcgccttcagcttttttattgagcgcttcggcagtaagcttaaagttgtttttccattcccctgacaatgtctcggcaaatacggtcggcgcgattgctttcagcttgtcgtatacttcttcttggcggattttgttgccgatgattaagtcaggcttcaggctcgcgattttttcaatattcggcgcagcctccgttccgacgttctctacgcctttcattttatctttaatatggtcataccatggatctcccagccaggattgaacggcgccgacaggttttacgccaagtgcgagcactgcttctgtcgcttcattcgtgagtacgacgacttttttcggagtgccgtcaattgtcgctgttcccattgcgtgctttacagtataggaatctttgctgccgttcttctccgcagattgatctttatcttgatttccgcaggcggctaataaaaggataagcgcagcgaacagtgcaaaccatttaaaacgtttcatgatatgtaggatccccttttctcaagtgattttcattatcaattagattatataatgaatcaacctaaagtcaatatgaaattcctatatatctgttttggattgtgctaaaaaccgcttttgagctgcatccggataaagaaaaccctgctcggcagacactgtacaatgagcatatcgtcttcttacgaaaaccgggatgatcctccttctagacactttgaattcattaggttaacataatcttgtatgaatatgttttttttaccatagtaaggaggggtgatttgactaagtttttattgagtggtttctaccttttcggacttgtcatgctgagcaattggtcgatttcttttggtgaaatatttggagccggcaattcagccgtttttcaattatcggaagcggtgctttttacgtttatcatcgggtgctatacaggtcttcctttgatttatgccaaattcactagatctgaaacgttgttttttacaaatcaaaaggtcttcctcatcaccttaggattaggcgtgctgctttcctgttcggcttacagccttcagcaagccctctctcccatcgcgattgcgctgttgtcgatcattggttttttgatcgttggcatcagcggttttcttcccgcctggtttctgaagcctgcgaaaaatctgcgataaacgggtgggtttttcttaggctgacggggtgttggagccaaggtcgaactcagtggtttctataaacggcgctggtcaatatggtgctctgagaaaatcacttgccaatgcgtaatctgacgattgattttttaaaaaacaacatttgctttcgccatttacaaattaatgaaaattctttatgatatagatatctaagtaaacatgttgcatatactaaaaagaccgaagtgctccaacacttcggcttgtacaaaaagccggcccttcgaaggggcttgctcagattgacctaaaatagaccactccctatcactttccaggctcaaggggcggtctatttttctttgttctctgacaacatggcaatcagcatgccaaaagcaatcattaaagagattgtttcatatgctgtcatttttatcaccccctttcagaaggggatgagcaagacttcccttgagtgagcaaagctttttatacgaggtagattataccatatcaaggagaacataaaattagggaaaaaacctttttcactcatgaaatctagcttttccgccgaattgcttcgacatcgactaaattcttggtctttcagctcatttattgattgaattcattagcttgaagaagtattcacgttgaccggtcttattgagttgataccatgaatccaatgtatccggtgcaaacacgtctaattttttcagcacttcccttgcgaattcgagaggagccgctcctgatgcagtaaccagattcccatttgataccgcgggtcccatctcataaaacggttctcctttataatgaggacagaccattttcatataggccaagtcattgcttgtatgctttcttgaatccagatatccgctattcgccagtcccgcagttgcacctcatattgcggcaaccatcgcgccaagctctaaagcttcgccggcctttttcaagatcggctgatgaatcttttctccccaagtattccctccgggtaaaatgattagatccgcactctcgggcgtccactcatcaagggagatatccggttttatgcgcagtccacccatcgtcgtcaccatttctttattcactcctattgtcatgacttttaaaggtgccgcatcttttttgaaatatcttcccgagttcagttcggccattaaatatccatattcccaatctgacattgtatggaatgcataaagatatactgttttcgactgcatccagtaacactccaatcgcaattgatacagcctattataatcaaaaaccctgacagcttttgtcagggtaaaggaaattcagctttcacatttaaaagaggttggccgcatctgcagccaacctcttttttatgcttacttattcaagttgtagaaagattgaataccgtggtattgcgcagtttcagccaattgatcttcgatgcgaagaagctggttgtatttcgcaacacggtccgtacgagacggagcacctgttttgatttgtcctgcgtttgttgccacagcgatgtcagcgattgtgctgtcttcagtttcaccggagcggtgagagataacggcagtgtagcctgcgcgtttcgccatttcgatcgcatcgaaagtttcagtcaatgtaccgatttggtttactttgatcaggatagagttgccgacgccgtttttgattccttcagcaagctttttcgtgtttgttacgaaaaggtcgtcaccgacaagctgaacttttgagccaagacgctcagtcagaagtttgtggccttcccagtcgttttcgtcaaggccgtcttcgattgagatgattgggtacttagaagtcagctcctcgtaccagtcaaccatttcagctgacgtttttacaacgccttcgcctgcaagatggtatttgccgtcttctttgttgtagaactcagaagatgcagcatccattgccaatttcacttcttcgccaggtttgaatcctgctttttcgatcgcttcaacgattgtttgaagcgcttcttcgttagatccaaggtttggagcgaatccgccttcatcacctacagctgtgttcaagcctttttctttcaagactgatttcaggctgtggaaaatttgtgctcccatgcgaagtgcttcgcggaagttttccgcaccgacaggcatgatcatgaattcttgaatgtcaacgttgttgtccgcatgctctccgccgtttacgatgttcatcatcggtacaggaagcgttttagagttgaatcctccaaggtattggtatagaggaatctgcaagaaatccgcagctgcgcgggcaacggccattgatacaccaaggatggcgttggcgccgagcttgcctttattttcagttccgtcaagttcgatcagcaatttgtcgattgatacttgctcagtcacatcaaagccgataagctcgggtgcgatgatttcgttcacgttgttaacggctgttaaaacgccttttccaaggtagcggtctttgtcgccgtcgcgaagctcaacagcttcgtattcgccagtggaagctccgcttggaaccagcgcgcgtccaaaagctcctgattcagtgtatacttcaacttcaaccgtcgggttaccgcgggagtctaatacttcacgtgcataaacatcaacaatgtatggcatgtttgtttctctcctttaatgcttatttttgaattaatgacgatcctgtcatttctttcggtttttcaacacccagcaagtctaaaagagttggcgccagatccccgaggattccgccttctcttaatgtcacgccttcttttgtgacgatgacaggaaccgggtttgtcgtatgtgcggtgtgcggcttgccttcttcggtaatcagcacgtctgcgttaccgtggtcggccgtaataatcgcgtagccgccttttgcaagaatcgcatcaacgacttcgccgaggcactcgtcaaccgcttcgattgctttgaccgtcggctcgacttttcctgaatgtccaaccatgtcagggttggcaaagttgaggatgatcgcgttatgcttttcagcctcaatttctttgacaagcgcatcttttacttcatatgcgctcatttcaggtttcaagtcatatgttgcgactttaggcgagtcgattaagattcgctcttcgcccgggaacttttcttcgcgtccgccgctcataaagaatgtgacgtgcggatatttttcagtttcagcgatgcgaagctgcttcagcccgttttgggataaaacttcgccgactgtgttgtcgagattgaccggtttgaatgccacgtatccgtcaaccgtttcactgaaatgtgtcaagcaaacgaaatgaaggtttttcggatgcttgtctccgcggtcgaagtcgcggaagtcgtcattggtgaacgtgttggaaatctggatcgcacggtcgggtctgaagttgtagaaaatgaccgcatcgttgtccttgattgtcgcaacaggttcgccgttttctttcgtaatgacggaaggaatcacgaattcatcgtaaattccgttttcataagaatctttcacgacatcgagcggattttgatatttcggtccctctccgtatgccatggcgcggtacgctttttcgacgcggtcccagcgcttgtctcggtccattgaatagtagcggcctgacaatgttgcgatctcgccgacgccgatttcttcgatttgatcctgaagctctttgatgtacttctcagctgtttgcgggcctacatcgcggccgtcaaggaagccgtgaatatagacgttttcaacgccttcttttttggcaagtttcaagagtgcatataaatggtgaatgtggctgtgcactccgccgtcagacagcagtccgaacaagtggaggtttgtgcctttttctttcacgtgcttcatcgctgcaaggaatgtttcgttctgttcgaattctccctcgcgaatcgcaacgttcacgcgcgtcagactttggtaaacgatccggcctgcgccgatattcagatggccgacttccgagttgcccatctggccgtctggaagacctaccgcttctcctgaagctgtcagcgtctggtgcggatacttgttccaatagcggtcaaagttcggttttttcgcttgggctacggcgtttccgacggtttcgtcccttagtccaaacccatctaaaatgatgagcgcggctaacttgttactcatattgacctgcctccaataattgcacgaaagactgcggctcaaggcttgctccgccaacaagagcgccgtcgatatcggattcggccatatattctttaatgttcgcaggttttacgcttccgccgtactgaatgcggacgctgtctgctgcagtttgtccgaactctgatgccacggttttgcggatgtgcgcgcatacttcgtttgcatcttgtgcagttgaagacttgccggttccaatcgcccagatcggctcataagcgatcacggaagcagctacctgttcagttgttaaacctgcaagtgcttttttcacttggtctgcaacaagctcgtttgttttgtttgcttcgcgctcttcaagcgtttcacctacgcagatgatcggaacgatgccgtatttaaatgcagcatgcgcttttttgttgaccgtttcatccgtttcagcaaacatttcgcggcgctcggagtggccgatgacgcagtattcaactccaaggtctttcaaagccgcagggctgatttcacccgtgaaagctccgctttcttcaaaatgcatgttttgcgcgccgactttcagatctgtgccttttacagctgatgtgagcttttcaaggaacagtgcaggcgcacagacaacagcttctgctttatctgctgcgggaatggaagatttcacttcttcaacgaagctgacagcttctgaaagcactttattcatcttccagttaccggctataattggttttctcatgtgctccactccttatgctgtatattttgcttacttgtcgttcaatgctttgacgccaggaagttcttttccttccataaactcaagggaagctccgccgcctgttgaaatgtggctcattttgtcagccaagccgaacttttctacagcagctgcagagtctccgccgccgatgacagagtatgtatcatttgcctctgctaatgcttcagcgacagctcttgttcctttagcgaacgcgtcgatttcgaatacgcccatcggtccgttccaaacgacaagcttgctgtttttgatgacgtcggcatatgtttttcttgtttcctcgccgatgtcaagcgcttcccagtcgctagggatttcgcttaccggcacgattttcgtgttggcgtcgtttgagaaatcgtcagcaacaagcacgtctgtaggcatgtagaagttcacgcctttttctttggcgcggtccatgaaagatttagccaattcaattttatcttcttccagcagggattttcccacttcatggccgagcgctttgacgaacgtgtaagcaagaccgccgccgatgatcaggttgtctactttctcaagaagactttcaatcacgccgattttgtcttttacttttgcgccgccgatgatcgctgtaaacggacgttcagggtttgacagcgctttgcccagcacttcaagctctttttccatgaggaagcctgcaacagccggaaggtgttcagcgatgcctgctgttgaagcatgggcgcggtgagccgctccgaatgcatcattgacataaacgtcagccaggtcggcaaacgctttagaaagctcaggatcattcttttcttctcccggatagaagcggacattttccaatacgagaatatctccgtctttcatttcggaaatttgcgctttgacggcgtcgccgtaagcttcatccgcttttttcacttctttgccgatcagttcgccgaggcgtgcggctaccggcgttaagcgaagctcttctgacacctggcctttcggacggcccaagtggcttgcaagaagaactttcgctccctgctctgttaagtattgaatcgtcggaagtgcggcgcggattctcgtatcatccgtcacttttccgtccttcatcggaacgttaaagtcaacacggcagaaaacaacgcggccttttacatcaatgtcttttactgattttttgttcatggcttttaggagatcctccttttaatgttttacaagcctgaaaacggaaatccccgggcggcttaaaggcgccgatatggaaaaagggaaagggagtgtgtgtccccttcccttgtccgctttcattatagcgcttctctcatcaagaaccaagtctgattctggtttccggattaaagaccttgttttgcgatgtaagcggcaaggtcaacaacacggtgagaatatccgctttcgttgtcataccaagaaataactttaaccatgctgccttccataaccattgtagaaagagcatcgattgtagaagagtttgtattgccgttgtagtctttagatacaagcggctcttcgctgtagccaagaacgccttgaagttcgccttctgctgcttctttaagcgctgcgtttacttcttctgctgttacttctttgtcaagttcagcaaccaggtcaacaagtgatacgtttggtgttggaacacgcattgctccgccgttcagttttcctttcagttcaggaagtacaagggaaacggctttcgcagcaccagttgttgtaggaatgatgctctcagctgccgcacgcgcacgacggtagtctttgtgcggaagatccaggatttgctgatcgtttgtgtaagagtgaacagttgtcatcataccgcgtttgatgccgaatttgtcgttcagaacttttgcaaacggcgcaaggcagtttgttgtgcaagatgcgttagagataacatggtggttagccgcatcgtatttatcttcgttaacacccataacgattgtaatatcttcttcactcgcaggagctgagatgataacttttttcgcgccggcttccaaatgtttcgccgcatctgcgcgttttgtgaagaaaccagttgattcaacaacgatttcaacaccttgctctccccagcttagtttagaaggatcgcgctctgctgtaacttggattgtttgaccgttaacaacaaggttgcttccgtcaacagaaacctctgcgtccaattttccatgtactgaatcatattgtaataggtgagcaagcatgttagcgtctgtcaaatcgttaactgccacaacctcaacttcaggattatttaatgctgcgcggaatacattgcgtccaatacgaccaaaaccattaataccgacttttactgccatgatgatttcctcctttaagtaaataagagatatttaatttatattgagggaagaagcttcccttaataactgttttgcggctccttcatcagtgatcaaaaccgtattgcgcggctttttgaagtatgcctctatggcgtcagcttttgacgagcctcccgccaccgcaatgatgttcgggatcgaatcgagatcctcaagctggatgcctacgctgtgcactttgtgaatgacttccccgtggcggtcgaaatagtagccgaacgcttctgcaactgcctcattttcttctattttcttcaaatcttcctttggcgtatttcttcgttctgccattgttttagcatccccgattccatgaatcaccatactggatgattgaatcgtctgaagcacttctttaatagaaggttcctcaatgatagaagaatatgcttctttgctcagctgccccggcacaaataacagtttgtatgtaccggaagctttctcggccatatgggcgcaaatcgtattggcctgattcctgacgttttcgcccagtccgcctcttgccggaacaaaaagcagcttgcggtttttcgagtcaggcgtcatcatttctgccacggcctcaagtgtcgtacctccggttacggcgacgatattttcccccgtaaacctatttttcatgcatgcgacggccgctctccccatctcttttttgacccatggggactggtcgctgtctcccgatacaatgatgacttcgtcgaggttcaacctctcttttaatgtattttccaaatgagttaaacctaaaacgtccttcatcgtatcttcgagaactttcagcaggtcggatccttcaggtgtcaatatcatgccggttgttttaatctctagtagattttgttcttttaaaaactgaacctccgcccttaaaatccgctcgctgatgccgaggctggcagcaaggcttcttctgccgatcggttcagtcagccttatgtactgcaaaattttgtaccttttctgcatgacatcgagaagatccggcaataattttttctgagcctgtattagttgattcatgccaaaacgttcctttcatctcatcctggacgaataatgtcccgcagtgactgaaaacgtcccacctcagccaaaaaaaattactcctgcttacattccttattgtaacagggttaaaatgtttattcaactgttaagaaacaattcatcgacaacattcgcgcgaacgttcacacttctgttttaattattgttcctgataatttctatattatacatatttcataaaaacgtgcctcaatgaaaattagcccttttatttcatgcaaagctgttcgatttcttccaggcatttttctagattatattgtagctatttcaaaaataaatatattgctaaaatacgtacttaccagcaaaaaagcaacgggcggtttttccgttccgttgcttttttgcgtttatccgtttttccatacatctgcaatgatttcgaacgagcgaagtctgtcagcatggtcaaatgtttctgaattgatcatgatctcgttcgcctgagtcgtccggatgaactcttcaagcttttctttcacactgtccggcccgccgatgatcgttgagctgagctgctcgttcaccatcgctttttcgcgcggcgtccaaatctgttccatatcatctacaggcggcttaagctgtgtcggagcgccgcggacaagatccaaaaacttctgatagtgcgacgttgccaggcgctgcgctttcgcatccgtatcggctgcgataacggtaaccccgaccatcgcataaggctccttcaagacgccgggcttaaacgaactccgatacagttccaaggcaggcagcgtattggcgggcgaaaaatgagccgcaaatgcaaacggcaaaccgagctccccggcaagccgggcgctgaatccgcttgaaccgagaagccaaatcggcacatcaagcccttctcccggtatggcgcgcacatgatttcttacattgcccgacggcttaaaatattgccgcagttcttcaagctgctcgggaaaatcctccccgctgcttatgtttcttcttaatgcgcgcgctgttaattgatcagtgcccggagcgcgtccaagtcctaaatcgattctgccgggataaagggattcaagcgttccgaactgttcggcgatgacgagcggggaatggttcggcagcataatccctcccgagccgatgcgcattttcttagtacctccggcgatatagccgatcaaaacagaggtggccgagcttgcaacaccttcgatattatggtgctcagccagccagaacctgtggtacccccatttttcggcatgctgcgccaaatccatagattgtttaaaagattgttccgcatttccgccttgtacgataggagacagatttaatacggaatacttcgtatttttgaaatgctgttctgacattgtctttccttcttcctgaagtgtagtggtcatgtaattagacgataacataatcgtcccggtgaataaaagaaattagttcgaaaaaaatcgaactaatgtataaaaagcttgcctccgctgggaggcaagcccttttttaagaagcggccgtttggccggctgtctggtttcttcctttaaagaaataagcagcgctaatgagcaaatagatccccgccgtcaccaatgtaatgacaatcgacgtggtcaggatgacaccgatcagtatggctgtcagcgaaatgattgccacccaagtcgtataagggaaccatttgacatagtagccgtttccagctgtttgattccgtttcctcgattttaaatgggcggcggcaatcagcatccagatcacaaggacggtatagccgagagaccccatcaaatattcaaacgtttggctgccggcaaatagtgaaaacaatacgcccaagtataagaacgaagtgcataatagaatcgaataaaccggcacctttctcgcagaaagcctcgaaaagattttcggcattcttccgtctgacgcctgtgtatacaaaatacgggaggcgccgtaaagccctgagttcatagaagaaatgaccgccagtaaaatgaccgcattcatcaaatgatccgctccgggaacgccgatcatcttaaagaccatgacaaagggactctccgacaccccgttcacttgattccatggaatcaagctgacgatcacgaaaaacggcagaagataaaaagcaataatgcgcgttaacgttccccgcacggctttaggcacaaccttctcaggatttttggtttccgccagggtcaccccgataatttccgttccgccgtaggaatagatcacgacaagcatggctgtaatcagccctccggcgccattcgggaagaagccgccatggtctgtcaaatgagtaaagccgacagccgaatgttgtccaaaagagaaaaataacaagataaatccggatataataaagacgacaatcactgtgattttaatgagagcaagccagtattccgtctcggcaaagcttttgacagaaagcaaattcacgctcgtaatgacgagtgaaacgaacagcgccagcacccaaatcggcagccccggcagccagtactgcaaaaacatcgcggcgacaacagcctcagccgcaatattgagaacccacattttccagtatatccagtccaaaaaataagcggcatacggccctaatatcgattgaaccagatccctgaatgttctggcttcgctgtttcggacagccatctcggccagcccctgcataataaacagcaaaatcacgccgccgatcaagtaggggatcatgaccgaaggccccgccaaatcgatcgctttgctgcttcctttaaataatcctgccccaatcgctccgcccaatgccatcatcataatatgccgcgatgtcatcgtgcgctcgagcttctgcatgtctttctccatctatgttcacttcctctattaaaataaaaaagctcaccgtctccctcttcaatttgaagataaagagacgatgagctttgaagcttaccgcggtaccactctttttgatcctataccaagaatccagctttgcgaagcacagccatgctgtgcaaacctgttaacgaaggttaatcgtaaagtcctcaggaattgatgtccgtcctttagccagtccactcccgggcgagttcaaaggttcattggtctgcgtctcacctacccgcagctctctttgccaatgccgatcttttactgctcccgttcattgtgttttcttctgcctgaaatatattcatataatatacgtgccgatcttcactttgtcaacatcaaatccgatgccaaaaaataaaaattaaaatttttctcttttttcaaggaagatcgccttttctattggaaaatgcaagggcagatatgcacaactttcataatgatagagcatgaaccaaaaaaggaaaatgtaaaaatcggcagatatcccccgaaaaaaatagttaaattgaaatattattcaaactttacaaaatattttaacgatgatagagtgtgaaccgaatcataacatcagctaaaggaggaagagaacatgaaaaaactcttgtttatggtgatcttgtccgtattgacgctcgtctttggttcatcgtccgtaagctttgcgaaggacattcctgaagacaggtatacaacacctacagatgctgaatttagccagattaaagagattttaaacgaggctgatgtcgaaaccggcaatttgcagaaggattacggtgtgatcgtcaatgatcctgctgaaaaggtcggcgtcatatcggacattcctgccgaaaaagatgactggagccatgtcagcttccattcttactatgtcgacctcaacagcggcacactcattgctgatgttcaatttgaattcacgcaaaacgatgacggtacatcagaaaccgagtacaaaaacgtaacaaacggaggcaggtacttcgtcaaaatggatcaagacggaaatgtcattgatgaagcaacaaccggcgacatgtcgattttgtggaaatactagaaaccgagccgccccttatggaaaacgcctttattcaaaggcgttttttttggtcgtatatttaatggatctatccggtggcgccatacgggtcagcaagattaaagacatgaggcccgaacaatgccgaactcatgcctgtcaaaatctttctggaatattagcccaccatagtgtcaagacacaacgcgttcctccgagctgtcgataaagatgtcttcaagcgacggttcatcgacgtggattctgtagattcccaccttgcagttcgttaatactctgacgatggcaggaattttttcttctgaattgacgatgatcgaaatctcatggtgcttaaattgaacgttttcaccagctgactcaagaaatcggtcgatcaggccgaaatgctgctcgggaatattcgaatggcggatgtgaacgcttatgttcgacatgaaatgccttcttaactcatcgagcgtgccttccattaaaatgcggccgtttttcatgatcgcgattcgtgtacagattttctcgatttcatgcaggttgtgtgacgtcataaataccgtcttaccttctttttgcaaatccataatcagcttttgaatgtggagtgccgattcggcatcaacacctgatgtcggttcatccaaaaagatgagctcgggatcatggatgatcgcttgggcgatgccgagcttttttttcataccgaatgaatacgcgcccgcttttttttcagtatgctcagtgaaccctaccctctctaagacttcttcgcaacgctcagtcgatacggtccgtccgttcagctttgcaaaatacttcaaatgcccgaccgctgtcattgaatcatagagggtcaaataatcgggtaaaacgccgatgcggtgcttgacgctttcaatcgaagcttcatttaacagcagaaaactgccggctgtcggctggataatgcctgtgatcatattcataaacgtagatttccccgcaccgttgcggccgaggaatccgtaaatctctcctttttcaacttgaaggtcgacatggttgacgacggttttggcgccgtagcttttcatcagcccttttgcctcgatcaccacattcattataaatctctccttttaaacaaaacgatcgcaccgcaaagaacgatggcggcgtagacaaagttgatgaaaataaaagaaccgcccagtacggagtaatagtacggcgttatatatttaaaccaggtgatcatgccgttctctgaataaacagcccataaactgaccgctggaaaaacgagagcaaacacgattccgaaaaacattgacacggcgggccttgaaatcacgatcgaaaataaaaggttcaaagagatcgcagctgtaagaaaagccatgctgtctgcataactcagccataaaaactcttttgaggcgatcatcaccaaggcataagaaacgagcatgcagaaaaaccaaaacagccagacgccaagaaactttcccagaatgatcttgatccgcgacgttttcgtcacgagaaatctgaccgtccgggtatggacttcgcggttgatcatgtcatgggaaagccccgcgataaacaggaaaccgagagcaaacacgataacggccgttccgatcgcgcctgcatcgcttcctaaatccaattcccgcacgacatccgcaggcgcctgttcaatcaatcccgcagtcttatagctcacccaaaacataataataatgacaataatcgacttgatgcttttaaaaagactgataaattcgttcagacacactgcccgcatatgagtcactccttcactattctccattatagtgagtgaacattatcgggaaataatcttatccttaacattaccttaaattttaatagactctttctatcaggggtgcttctgtggattataaatgagataaaaaatctcgcaagcggcttggacctgcggcagaaatgtgtatgcagagccggcgatccgataaaaataccattttaatatactatttataatcggcaaaaaaagcagaacgatgcgttcaatctgtatgcgccggaattgtcatatcgcataataaaaaagattagctcagtatgaagctaatctttttgctatcgataattaccggtcctccacgactatatatgccgcctttacggggccgtggacgccgactacaaggtccatttcgatatcggctgaattgctcggtccagtgacatagttgatgcaggacgggatgacttcgccgtctgcaatcttttgtttgatgattgcgcttgcttgtgtcatccgcgggacgatggtgcttttcgggacgatcgcgatatatgtcgtcggcagcaagctgacggaacgtcctttgtcttttgagctgaagaggacgaccgttccggattcagcaagcgtgatctcgctgaatgtcacgccgatgttagcctgttcggctcgctggatgttctcatctccggccgctgcatcccattcccacactttcgtcccttcattcggccacttgtccgttaacaggcctgacagtccgtactctttaaaacggtcatctttcgggatcatgacaggcccgcctccaaatcgcgctgcttgttcatacaaggcatcatgcaagccgatgacatctgtttcaatcagctccgtgtgaattttccggcagtggtcctttaagacgccgacaagctcatcctgtgtatagccttgatataccctgtgctgcggctggtggatataatcgggaacggtgacgcctgcagaacgcctgttgcggccgagcctttcagcaatccggtttaaaaagccgtctttgttgtggattgttccgtttgtcatttgtcttcccccttctctttccgtctgtcctcaaaccagtcgcggaaccttgacttgttcggcgcggggaagtcgcgtatctgggtccactgttttaacggacccggtcccttcgtaatcttgccgtcttctttaaacggcttcatggctgccggcgcccatttggagcccattttgtaaagggatggcgcagaagttcccaagccgaacgctttcatcgccagcttttcggatatcggcgcgcgcccttctttttcaacgatgcgctgcctgtgctttagaagcagctcatgaagcgggattttcaccggacatgcttcagagcaagccgcacataacgaagatgcgtacggcagttctttataatcgtcatatccgccgagcagcggcgacaatacagccccgatcggacctgaatagatcgaaccgtaagaatgcccgccgacatgacggtaaacggggcagacattgatgcaggccgcacagcggatgcattgaaggacggactgaaactccgttccgagaatgttggaacgcccgttgtcaacgatgacgaggtgaaactcctccgggccgtccgcttcaccgggcagcctcggccctgtcagcgccgtgatatagctcgtcagccgctgtccgaccgcgcttcttgtgagcatgccgacgagaacttcaaactcgtcgaatgatgggacgatccgctccatccccatcacggtaatctgcgtcttcggaatagtcgtgacgagacgtccgtttccctcgtttgtgacaaggctgacagatcccgtatcggcaattgcaaaattgcagcccgtaatgccgatatcagcttcgagaaatttctttctaagcacggcgcgcgcgtgcatgacaagctcttccggcttttcggtgttgcggtagccgatccgctctttgaagacgtcgcggatttgctctttgtttttatgcaaagcaggtgcgacgatatgtgacggcggatcatgatcatcgatttggaggatgtattcgcccaaatcggtttcgaccacttcgcagccgtcgctttcaagtgcctcgttcatgttgatttcttcggtcaccattgattttgatttgacgatttttttgccgtttttctttttcacgacatcgcggatgtagcctgtcgcttcttcagccgtctgcgcaaagaaaacgtgcccgccttttttggcgacattttcggcaagctgttctagatagtaatccagattttccagcacgtgctgcctgatttcttcggccagagaccgccattcttcccagttcccgagctcttttgccgcctcaagacggcgcgctctcaagcgctcctgcgcgcttgaaacggcccccctcataaactcgttgtcgagcccgtctgacacgcgctctttaaatttctgcgttccgatcttcattgccataacgaatgtccccctctatctgtgaaatgaccggattgtctgtttatctgctgttcagcacttctgcgatatgcatgacttcaatcggcttgttctttctcccgatccgcccgccgatattcatcaagcagccgcagtccgccccgattaacacgtcggcggctgtttcttcgacacacgccactttctcatcgaccatctgttcggatatttgcgacatcttcaccgagaaagtgcccccgaatccgcagcagtcgtgtttgcgcggcagcggcgtgaactccagtcccttcacatgccgaagcagcttcatcggcgcgtccgtgactcccaaaagccttgtcatatggcatgacgtatgataagtcgcctttttctcgagtgtcgccccgacgtcctcaatcttcaatacgttgacgataaaatcggtcagctcatacgttttgtcagccagccgctgcgctttttccgcccaggccggttcatcccggaaaaggtgcgggtactctttgaacataaaagcgcacgatcctgaagggctgacgacgtattcagctgattcaaacgtctcaatcatccgtctcatcgcttttttggaatctttgacatagccgctgttgtacgcaggctggccgcagcagatctgcccttcgggaaaatccacttcacatccgagccgctccagcagttcaacagtcgcttttccgacatttgactgaaacatgtcaaccaaacacgtgataaacagtgatactttcatcttgatcccctctccaacccgattaatcaggtcatctgatgacttggttagaaaaccctctttctccatcttacaccttggcaaaattttttgaaaggggtttctttttcgttttcactcaggccgtgcagctgactgctgcttaaatagccggctcgtcggcttgtttcgtttcttcaaaatatgaggccagcacattttccacatttgtcagatgattgtgcatcgcttgctccgctttttggccgtctttttccttcacagcctgatagatggcttcgtgttcctcataaaggcgcttaacagttgtattcttcgagaacagccaaattttgcgcgtctccctcatcgtctcaattaagagagatgacacatgattcatcaagcctttcagcagatcgttctgcgaagcgccggcaagcgcaaggtgaaacgcgaggtcggctttttcgccaagttcgccgttcccgtccgccagcttcatatcctcaagtgcttcctgcatgcgtccgagatcatcctccgtgcgtttttgagccgcactggaaactgccccgatttcaagtattttacggacttcgagcagttcagcgacatctttctttttcatcaaaagtgcagccgaaagggggatggaaatttgctcaggctcaaaccttttcacatacgtcccttccccctgcttcatttcgaccatccccatcgcttttaacgcggacagcgcttcccttacggccgaacggctgacctgaaagctgtcggcgagcgcttggacggagtcaagcttgtcgccgggctcaagctctccgcttttaatcgattcaagaagcgcttccgcgacttcttcatatatttttttcgtcttgatttgtttgtatttcaacttttttcacctcgtaaccagactgggcatgatgcgctattttttattataccgttctttccgtctggaacatatagacttcggctccatgcaaaaaaagattgtaatttatgacattgagaaatataatgctaaatgatcagtcttatcatcatgtcatcagatgactagatgaggcttttttgacgaacaaagggggaattggagatgggatggacgcaagattatactccgctggggaacagtttgctgctctcttcgcttgcagcgcttataccgattttgtattttttctgggctctggcaatcaaaagaatgaaagggcatacagcaggcttgacgactttgctgatcgcactcgtgctggccgttttcgtatacggcatgcccgctcagcaggctgtgatgtcggcttcgcaaggcgcggtttacgggctgctgccgatcggctggattatcgtgacttcagtttttttgtacaagcttacggtgaaaaccggccaatttgaaatcatcaggagttcggtattgtcgatcacagatgaccgccgtttgcaagcacttttgatagcgttttcattcggggcatttttggaaggtgcggcaggcttcggcgcccctgtcgcgatatcggctgcattgcttgtcggcctcggctttaatccgttgtatgcggcgggcatatgcctgatcgccaacacggcgcctgtcgctttcggagcgatcggcatcccgattatcgcggttgaagggccgactgggattcctgcgatggacatttcaaaaatggtcggacgccagctgccgtttttatctgtatttattccgttttatttgatcatcatcatgagcggtttcaaaagggctttggaagtgctgccggccattctcgtgtcgggcgtctcttttgccgttacacagtatgtaagctcaaacttcctggggcctgagctcccggatattttgtcagctatcgtatcgcttatcgctctcgctgtattcttaaaattttggaaaccgaaaacgacattcagattctcacaagaaaaggaaatggccgctgcagcggaggcgcagcagcttgaacatcaaaaggcctcatactcggcggggcagattttcaaggcatggacaccgtttttgctgctcacggcaatggtctccatctggggaattccatctgtcaaacaggccttgacgggccattatgaaggttcaaatccattgctgctgttcataaatgatatcggcggcaggctgacgtttgcacccggcgtgccttttttgcacaatcaaattctcgatggttccggaaaaccgcttgaggctctttacaaacttgatctcgctggatcggcaggtacggcgatcctgattgccgccgtactgacaaagtttgtcacaggcatgccttggaaagaatggggcgccgtatttacagattcgctgaaggaactcggcaagccgatattaacgatcgcttccgtcgtcggttttgcctatgtcaccaattcttcgggcatgagcacaacactgggcatgtcccttgcgatgaccggttcaatgttcgcattcttttctcccgttctcggctggctcggtgtgtttataaccggttcagatacgtcggccaatttgctgttcggaagcctgcaaaaaatgacggcacagtcagtcggaatggagccggtgctgtctgtggcggccaactcttcaggcggcgtcacaggaaaaatgatctctccgcagtcgattgcggtcgcctgcgcagccgtcggactggcaggaaaggaatccgacttgcttcgctttacactgaaacacagtctgtttcttcttttcctcgtttgcatgatcactttcctgcagcatcatctgttttcgtggatgatcccgtaaaaaagccgccggcgctcgtgccggacggcttctttattgatatctctttcttacagacgaaggcagtatattgagctgatcacggtatttggcgacggtccgcctcgatatgacaacgccgtgcttttcgtttaaaaggtcggccagtttctgatctgaaagcggtttcattttatcttcttcatcgatcagccggcgcagatgcgctttgactgtgtgacttgacgcatgcccgtcagcggcgtcctttaccttcgccgaaaaaaaccgtttaagctcgcaaagctcaaaaggcgtctgcacgattttccctttgactgcgcggcttaccgttgattcgtgaacgccgagggcatcagcgatctcttttaatgtgagcggcttcagttcgtctttcccttttaaaaaataatctttttgccgcaccatgatttccgccatcaccctccgcatcgtttcccgtctttgcctgagggcattgtcgagccatttccactgcttgaacttatcagagatataagcggtcgcctcgtcttttgactgacgctctaaaaacggctcgtaaaacgcgttaagctggatgtcgggaaaagaacggctgctgagctcaagcaccaattttccatcctctgctgaaatgattaaatcaggctcgacatagacttcgccatcatctgtgccatatatcaatccgggacgcggcgacagttctgcgacaaggtcttgaatgtcctgaagctctgaaagcgaaagccccgctctctctgacagctctttccatccctttttggcaaacaggtcaaagtatgaggaaatgactttttccgcttttgccgtctccttgggcagacgctttaattggatcaggatgcattcctgtagcgaccgcgccccgatgcctgccggatcaagagtctgcagcttgcccaagacttcttcagcttcttctctggtgacagccagctcggaagcgataaaggcgatgtcttctgtcacatatccgtttggatcaagtgattcgaccaaatagctgaaaacccgcttttcgcggcttgacagctggagatcgagcgcctgccgtttcaaagcgcttttaacatcttcacgggaatgggccgtctcagagcggcttattccttcattttgcaaatgacgattcgttttatggtaaaatgatcggggaatatcggagtcttttcgttcgatcagggggttttccaatgagagttcatcaatccggctgttcagctcggccgacgaatactgaagcatatgaatggcttgggcaagcccttgcgtcaagtgaagttttgccgtttgctgctgctgtacatgcaagttcatcatatctcccctcccactattagtttacacgatcggttccgaaccgtatagacttaaaaaaggagtgttaccattgacagagcttttctccgtgccctatttcatagaaaattttaaaacccatattgaaatgcatccaaatgaggataaaatccacgcgatgaacagctactaccgttcagtcgtttcaacgcttgtgcaagaccagctgacaaaaaacgccgtcgttttaaaacggattcagcatttggatgaagcctacaacaaagtaaagcgtgaagaagcatagcaaaaaaaccgcctgtcatacgtgaacaggcggtttttctgcttctgtctgatggttttgaatcagtttcgtattcgggatgtctttcatccatgtattgtagtaattcgcgttttttccgtaggagttgtcaatcactacgttttcttttccgagcaggcacgataagatgtggccgtgcagccttgaagtaacgactgattcatagcggctgaagaaacggattgatttgtcgacgaggctgtccgaaaagcgtttccaataagaagcgatcggcagcggattgcccgcttttttgttgaggacattgatcgtctgcaggcgtttgattccgcgtttgtcgccttctgataagatgacgttccaatcgtacgtgtccggctcccctgctttctgcaggctgctgttggcttctttgtcggtcctgatcaaccgcagaacggactcggacggcttttcggcaggtgccgcgatcggccagagctggtgagccatatcgggcatcattttgatgtttttcacctcttcgaaacgcttgacggcaaaatcgaatgatgccttttcccgcgtgaataagtgcagatccgggtgagccgccaaaatgccgcgcgtttttattatattttcttcatgctcataataaatcgactgcggcagaatgacgatccggttgtccgggtaatgttcgaccacccgttctctgaactgctggaagtgagggtacaagtcgccgaaattgccgcccccctgacaaacaatgatggcgtcctttggaatgcggcggcccggaatgaaattctccgcattccatctttcgcgcaccttgatgccgtatgcttcaaaaaaagcttccgttcctttcatgatcaatagatccccgacgtttccgtatagcgggtagtccaagtaaacgactgatgaatgccttggaatgacatccaaaatttctgccagcttatgctttaagctgtccatggaatatgtaatcgccatgtttagcacctcatttatatttaatccggtcggcaacgatttgaattacccggtcctgctcttttcgcgtcatacttgatcctgacggcaggcagagcccgcgctgaaataagtcgcagcagacagagccctggtcatcgtgcggataaaaggccgcgcctttaaaaaggggctgtctgtgcaaaggcttccataacgggcgggcctcaatgttttcatttgcgagctgttcgatgatgtccgccggtgttgtttgaatctttgctgtgtctaacgttaatgtcgtgagccagcggtttgacatgccggcctcaggcatgaattctataccttcgataccggaaagcgcctccttatagcgctcgaaaaccgcccgtctggcatgtacccggtcatccagaacggcgagctgtgcgatgccgattccggccagaacattgctcatccggtaattgtagcccgctttttcgtgctgataatgaatggctggctcgcgcgcctgagtggctaaaaagcgcgccttcttcaacgcgtcttcatcatcgctgaccagcattcctccgcccgatgtggtgatgattttgttaccgttgaacgaataaatgccgaagcgtccgaaggtcccgctttttctgcctttataaacagaaccgagcgattcggctgcatcttcaatgacaggcacggcaaatcgatcgcaaatggccataatctcgtccattttcgcgctttggccgtacaagttgacgacgatgacggctttcgggagattcctggcccgctccgcttcgtcaagcgcccgttcaagcgcctcgggcgacatgttccatgtatcccgttcagaatcaatgaaaaccggttcagcctgctcatatatgatcggattggcgctcgctacaaacgtaaaagaagagcagaagaccgtatcgcctttgccgacgccgagcaatttcaaggccaggtggatcgcagctgttcctgagctgactgccgcggctccggacgtccccgcataggcggcaagcttttcttcaaatgtgtcgacaaggggaccgaggggcgcgatccagtttgtccgaaacgcttcggctacatagcgctcctcgtctccgctcatgtgcggcggtgataaataaattcgcttattctgactcatgtttttcaccctttttactgctgttatttgatcattcttgcagggactccgactgcggtgcaattatcaggaatgtcgtgaatcacggctgcccccgctcccgtcacgctccagcgtccgactgtctttccgggaatgaccgccgttcccgcgccgagatgagcgccttccataactgtcacgccgccggttaacaccgttccgggcgaaagatgaacgtaatcgccgatccgattgtcgtgttcgacgatcgcacctgtgttgacaatcgcgtggatgccgacgtctgcatccgcttggatgacgctcgatgccataacaacggcgccgttttgaatccgggccgaaccgctgacaacagcagagggatgaatcaaaaccgcataccggtcaagcggaagaccaatgcgttcatacagctgctgtctgatgctgttttggccgacagccaggacgaacttcgcgtccggatgaagccgcgcaagttcttctgcggcagctgaaggccctcgatacagaccgttctcaacatgaagctccgcataccggtcatcaagaataccggcaagctccgtatccggccgctcttttacaagttcccgaacgactttcccatggccgccggctccgatgatcaccacgttttgcatcaggcattccttctccctgtaaatttttctgctgtcacatgccggtcctggctgacgccttccgacttcaaaacctttacgacagtcaacaaaaggattttgagatcaagcaaaaaagaacgatgatccacataccagacatcgagttcaaatttttcctcccatgtcactttatttctcccgttgatctgcgcccagcccgtgatgcccggcttgacttcgtggcgtctccactgccgcttcgtataaagggggatatactccatcaaaagcgggcgcggcccgacgaggctgaggtctcctttgataacgttgatcagctgcggcaattcgtcaaggctcgtttttctgatcagccgccccgtctttgtcagccgcttttcatcgcttagcagattgcctgctgcatctctttcatcagtcatcgttctgaatttatataatgtaaaaggctcgccattcagccccggacgggtttggcgaaataaaacaggcgagccgattttccatctgatgagacaagccgtcagaatcatggccggactgagcgcgaccagcaaaataactgacaatgcaagatcgaaaaaccgtttcgctagcacgaaaaacgcacccctttcttttatttaaaaaatcccttttgaaacgggaaggatagagaacaccggtatgcttgcagcttcgttgtgacaatgcgccgttccgctttcgtcaacatgacgaaataggcaaacaggccgtaagccaacgtcgcagccagtgccgtgacaaacaaagacagcaggctgacgatcgaaaataagtattgaagagcgtaacagacagccaaagtaaatgaagcgccggcaaccggcccgtatatgcctttataaaagaccctttttctttcacccgtaatctttgatgcataaatcggagtgaagacgacgtttttcagcgttaaagctgccgcaccggccagcgcaattccgtaaaggccgagtcccgccgggccgctcagcacgatggcaagcagcaaattgacaacgccgaaggcaaccgtggtcagcgccggtgttctcagcttgttataggcggtaaagatgtaaaacagcggcgccgggcttaatgaaacaaccaaatagcccgcatgtatcagtaagagccatttcaaatgttcgaatgaagggccgagccaaagcgacagaaacgggccggcaagcccccccagaagcgccgccggcaaagcgagcaggatgccgttaaacctgacggcctgattggcataacggacgagcccttctttgtcgccttttgaataatagagtgtaatcgtaggtgaaaatacggccgctagcgttcccgaaagcgtccgcaacaacagcggaaactgaatgatcgccgcgtacatgccggattcggaaacccccagcatcacattcgccaccattaaatcgatttgcagaaacagcaggatgccgacttggctgacggagctccatcctcccgcctgaagcagttttttgcactttgcaaacgacatatccctcacccggaacgtaaaccatggaatcaatctcttaaagaaaaagatcgacaggatgcacgccgaagcggttgcgatgagagcggcgagctgaatgtgccagatcttcggtgcaaaccacgcgaaaatcaacaatacgctcagaacgcgaatcagcatttggatggcttggatcgtgctcgtaatatagattttattggcgaaaaacggaccggcggcaaaccccgacatcacaaaggtcaataaaaacagcaggctgccgatcaaaagcgcgacctgcacatcccccaaaagaccggcgggaacgcgaatgatctgatcgataaaaaacaccgtgccgccgagcggaaaaaacaagatgactgaaagcaccagtgatgaaacgatataggtattcatatagcctctcgcttcatcaagcgctcccctgtgggcggaaacagaaaaaaaccggacaacgaccgcgctcagggcgaccgtaattatcgaaaagtaattgatcatattctgtgtaagatggacaaatccaaacgcctcaacaccgagggtcttgatgacgtaaggcgtcagccacatcgaaaacagcaccgataataaaaaagacgccatattggcgccgagattcaaaacaaatgtcttattcaaaaggctcatcccttactgggcagatttcgtttaaaaaacaattcgagcagaatcggaatattcagcttgcatagcaataaaacgagccgctggccgattaacaggttgcggttgcggagagacgtggctttgacgcacgactgcaccatccggtaagacaaaatgtctttaatgtgccgcctcacctgctttgaaggcttcggttccgcacaggcattggctaaaagcatcggaatttgatgtttgcatgtgtacgtttccaaatcgtccgcacattcatccaaaagctgaaacgtctcatagaatctccttttcgcccggtactgccttttcaggctttcatccatgtacggtttaaacggcgcctctgtcaggctgtccgggttgcacctgtacatgtagtagccttcatcgatcgctctcactcgtttcgctgcataaaaggcgtacaaattaaacggcgaatcctctgcaaaacgaatgtcttcaaaaaagtacagctggtttttcttcagcaggtcgcgcctgtacaaattccgccacacataccagatgaagcgggtttcgtgcgcctttttgagctcgcgtttaatatcccagctcaacaagaggcgatcggtcggcagcggcggcgggaagtaggcgtcttccgtatcggaatgtttatgatacccgcacatgacgatatcgaggtcgtcttttttggcagcggcgtacatgttttcaaacatggcaggcaatacaaaatcatcaccgtcgacaaacccgacataatctcctgtcgcggcttgaagaccggcatttctcgccgagctcagcccgccgttttttttatgaatcactttcactctggcatccaggctgcagtacgttctggctatctccccggatctgtcgggagagccgtcatcaacaaggatgatttcaatatttttcagcgtctgcctgcgcagcgaatcgacgcattcttctatataatcttcgacattgtacatcggaacaatgatactgataaatggcttcattggacatcacccataattttccgtcttaaatctgcgaaataatgatcccttgccggggtctcacgatgcgagtcaccggtcttgaccagctcttcgattgcgccgagaacctctgccgcatcgggattttccacaagcttcatcgaaggaacgtctttcagccagcgaaagccttcaagcaccttatgatcaaaagagcggatcacgacgcacggcgttcctgttatcgcacaaaaaatcatgccgtgcagcctgtctgtcacgacgacctccgcgcctctcagctgatcccaaagccggttcagctccttctcgcgggacacgcggctgaccctcctgccgatcgtcgttgtaaaagtttttgcaccgccatactcgtcgccgacagccttcagcagctttttacgctcttccggcctgagaaagctttctttatcctcccttaaacaaaccaacacaccttctctttcagactgctgttctttctttaaataaagcaccatatcaggctgctttacaatcgtttggtttgagaagtgctgtttcataaattgataggttgtatcatcgcgcgccatcatgaacagccggcgatgggagttgtagatttttttcgcccttttcagctcttttttgccgcggagcgtctcggaaaagtgcgcagttgccgggagctggacgattttataatgcttgaatgttttgataatgaagcgcctcgtccattcctcattgcggtacaaatcccccatgtttcctccgccgatgatgaataccatatcctcggggtggcggatgcgcatgagcgcttttgcatgtttgtaaatatcgttaatgccgatttcaattaactcaaaatcgggaaactcgttttctatgaatgtgcggcttgccagggcaatcgcatgatctcccaaattatcatgggacggaattaaagtcagaatgatttttttcttgcctttatattgttcaaagcgccttaaacccggcgttcccatcacatattcagaaggatatttcaccttgagcaaaagccattctgcaagattgatcttcagttcctgaaaggtcatttcctcaccgcctatttcttcattctgtgctcgatcattttctggtaaatggccgcaaatccatacactgccggcatcaaccgcaagcgaatcagcataagcaaaagcttcttcttggaatcgaatgccgacatgtccactgcggagattttccccctgaattccggacaggcgcatatgctgcggatatttttatatttttctattgaagggtttttgtttcggctcttgcattcatttaaaatactgatgcagccgtggttgacgataaagacgtgcagcgcctcctttaaagccgggagctctccgtgctttgtcaggcagtccaggtttgcttcataaagagcgagaccgtcttcaaacagccctgcctgatacttttggacgatggacgccaggtggaccctgtaatgataaagcggcttagtcacgaacgccgcggtattcgcatatagaaggcatctgaagctgaaatattgatcttcgatgttttccagctcgtcgcggagcgggaaaacgagcttatgccgctcaatcagactccgcctgtagagcttgttccaggaaaagccgcttactttaccctttaacaaatccttcataaatgcctctttcggctttccttcatagttcttcccgatgtccgggcagaccgttttttcggtatcctgaatttcaacggcataatcacagatgacaagatcggcatcctcatccttcgctttttcatacatagactggcaatagtccggctcaatccagtcgtcggagtcgatgaatgccaagtactcgcctgacgccgcttcgatgcctttattgcggacagcgccgaggccctgattgtcctgctgaatcgttttaatgcgcccgtcctttcgggcgtaatgatcaatgatcttctggcttccgtctgttgaaccgtcattgacgataatgatttcaatatttttcaaggtctggctgatcagcgactgcaaacaattcggcaaaaaagcttctgtattataaacagcgaccagtagactaactgctggattttccaatgtgatgactcctttgacgaaatttttacaagacctaaaatgtccggtctttccgctattcaacgttcaaaaatcgttctgtacggcaataccgacgagtcgaacggcatgagcataaagctgtataagaagtaacagatcaaaatcaaaacataaagaagcgcgtttgatttcggttcaaaaatccgtacaaaataaggaacgagaatcagctgatagagcccgaaataaatgttgaacctcgcaaaaatgacatcctttgtcgccaaaattccgaacaggaaaccgatcagacaaaggtttacgatataatcgacttcgggccagcgctttctgagctgctccctgaagcaaaaggcaagtgcgagcgggagaagaagaacgatgattttaataacgttcatgccgtttgtattcttcatcagccattcttcataatgtccgtattgactgttttcaagcacgactaggaatacggacagaaatttttgatacagaaaagtccccgccaaaaagacgagcatcaggcaccagaggacaggcgaccacgcttttcttctgacgatgaaataaaccggaatcatgatcaatgccgaagaatgaaaaagcgaacagatcagtacaacgatcatatagcgcaccagcttcccatcgatcagataccgcaccgcccaaaacagaatggccgccgccatgtattggcgaatgccgttaaacgaagcataatagtgaaacatgccgataaacagaaacatgctcaattcaaacggccttccatacacataaagcgtcttgacaatatagatataggtaatcgcggcaacgacggcaaacatgagcgccggatcggctgaaatctgatttaaaatccataagagtgcggtaaatcccgggtccgtcgacgacttgcctgttccgaaaccgaatatctcccaaatgctgttgtattttccggctaattcgtaaagcagcatatatgtgtggtaatccgttccgaccttgtatcttaagccggcaacgataatcaaagacgcgagcggaacgacggtgaggatcgcattcggacggtagcccgtcggcagcctgtgatcttccctgccgtacattttcgcaaaccatgaccagacgaaaacaatccccatattcaacatgtagacagccatacactcactgtccttctgctgcggagattgaatagatgtccatcagtctcgccaaatttgcttttgcatcatagcctctctcagcaaggcttctctctatttccggccatgcaggctttttcggctgagcagcacggctgatatcctcagcccaccgttcaaaaccggcatttaagctgagacgttgcagcaggccgagtcccaaatcggtttcttccgtaatgttgtctgatacaatgcaggggagccctgacgcttgcgcttcgaccagtacgaggggtagcccttcaaacaaagacggcatgacaaatacatcaaatgcctgcatgagagccgggatatcttcgacgacgccgagaaacagaatgtcgtcttttacaccgagagcagcggctttttcttccatctgtctgcgcagcggaccgtcacctgcgaacaccgcttgaaaaggtatgcccgatttcttgcaataagcggcaagcccgagcagaaacgcgtggtttttctgttcaaaaaaacggccgacatgcccgatcaccagtgcgtcttctttgataccgaagctctttttcgcattcgtttttgaaacgccgttcgcttctttgaaccggtcaagttcaatcccgttttgcaaaagatggaccgcgttttcacccatcttctttgcgccgaataaaaaacgcccggcatctttgccgcaagcgcacagagccgtagcactggagaaaatcaagcggcggaatgcaagaagctgccatgtatcccaaaaccgggggttaggcttccaggccgtgttgtgggaatggcagaccctgaccggaacgccggcgagcctggccgccaatgcggcaaagcccgtctgaaaatccgtatgagcgtgtacggcggcataaggccctttctcaaccaaaatccttctgatgtttttgatgtaggcgacaggacccgaccgaccgatgctcggtacataaaacacccggccgccgcgcgtgatgatctccgggtcgtaatcgcacgtttcttcccggtgggaaataaaatcaaattgaatatgccgcctgtctgtgtggcggtatatattcataatcatcgtctccgcgccgccgcggttcattccgcttacgatgtgaagcacccgttttggtctcacgcttccgtcattcatgttttacgacccctccgccttcattcatcaatcttcttttatgatatctgttcatgataaaaggaggcataagccccctgatgatgggtttcattgtataaatatagtccgatagcggcagcttcagccgtctgcaggcggcaaagacgataaacgcattatcaatcgagtagctgagctttctccttttaaacgccgattcgtcttcccttactttgtataaggcttcctgaaggttgtagcccgtgaagcccgcctcaaaaaaacgaagccacaaatcgacatcttccatccttcttgttctccggccgacccgatagccgtccagcgcctcgtagacgtcggctctcatcatgatcgtcgcatggcaaaacggcgtccctttcgccatgattctcggttctggagaggaaggaagcattctgacgcctctaatcccgttttcgtcgaaggccatcatgccgcttccgacgacatgataatgagattgcgattccaaaaacgcgacctgcttttcaaaccgcctcggcaaagagatgtcatctccgtcctggcgcgcgatatatttcccgccggcgtattggagacagtggtttaacgaggcagccagccgctgattcttctcgtttttgatcagcttaatcttatctgcgtaatgatcggcataccgcctggcaacagcatatgtcccgtctgtcgaagcatcgtcgcatataatcagttcccaatttttataggtttgatttaaaattgactcgatgctctctgcgatcgtgttctcacaattgtagactcccataatgacagaaactttcggcttttgaccccctatcatcctttcagcctcctttcaactgtttcgttatccataaaggaagagtaaatgcccgccatttctttgacggtgcgctgctgggaaaaagcggcggctgttcgtctccccgcgtctcccatcttttttcgcaaagaaggcagacggtacagctgcaatatccggtcgctgaacgttccggcgtctccctgcggaaccaaaaatccgttcacgccctcttgaatgacttcccggtgtccgcggttgtccgctgcaacggcgggctttcctgacgccattccttcaaggaggttcatgccgagcccttccctgatgcttgaggcgacagacacgtctgcaagctgaatccattcgtggatgtttttttgaaaaccggcaaacatgacgagcgaagaaacgcctttttgttcagcgtgatttcggtatttttgctccatctgcccttttcctgcaaacacgacctttaagttcggggctctgtcttttaaagcagccgccgtttcgatgagcaaggcctggtttttattcgcgttcagctccgcgggatatatgaggataaagtcgtcttctttgaaaccgtatgttttcctgagcagcattttctctgtttcactgacaggatgaaaccgctccgtatcgacgccgatcccgtggattttttccgtgcgcagcgcttttcgcaagccttttgcaaggacgaaatcttcttcattgatcgtaatcaggcaatcggtcaaagcggacagccctttttcaatcggataatacagcagccaattttttaaaggagcaccttggcaaaagtggaaaccgtgagcggtatagatcactttcgtcccctcttttctctgtttccgggccgcaagccttgccagcacgcctcccatcggcgtgtggcaatgaatgatgctgtaccggtgttcgtcaatgattcgcgccagctcccgataggcagcgatattgcttgcattcaaaggagaacgcctgatatcgatatcaaattttttatctgtatagggcagtgtcatatctccttttgcggcgatatgaacattccacccctgctctttaaaccattttaaatacgggaggtggaaggccttgaaatggtaatccacagtagcgcaaaacaaaaccgttcttgtcatgttcttccccctagtgcgctgtcaccagctttttctcgtgctggccgatcgctttgaacaagcgttctctcagctcgcggtctgacaaatacataaattcatccataaatgacttcagcaccgtccattcgacgtcgaccgccttgccgatatgaatcttcggaaaaacctgctctgccagcacttcattttgattcagcagctcttcgtacattttttctcccggccggatgcctgtaaattcgattttgatctgttctgtcgtatagccggaaagctggataagatttttggcgaggtcgacgattttgaccggttcgcccatatcgagcacgaatatctgtcttcctttggcaagcgcccccgcttgaataacgagccttgaagcttccggaatcgtcatgaagtacctcgtcatgtcctggtgtgtgacagtgaccgggccgcctttagcgatttgttttttgaaaatcggaatgacgcttcccctgctgccgagaacatttccgaagcggacggcgacaaatttggttttgctcgttttgccgagattcatgatcagcatttccgcgaaccgcttcgttgcccccatgatattggcagggttgaccgctttgtctgacgatatcaggacaaatgtctccacttcggtttcgtcggcggcctcagcgacgtttttcgtgccgaggatattgtttttgacagcttctttcgggcatttttccatcagcggtacatgcttgtgggcagctgcatgataaatgacattcggtttgtagcgttccatcagcaaaaacattttttctctgtcctgtatgtccgcgatttcgggataataggcgacatgctttccgaatttctccttcagttcaagcaggatcgaatggatgctgttttctccgtgcccgactaaaatgatcgatttcggtttaaatttgctgatttgccggcagatttccgagccgattgaacctccggccccagtcacaagtacgacgcggtccttgaccgtattggagatttcgctcgtatcgagctggacaggctcccttccaagcaaatcttctgctttgacatcgcgaagctggccgacaggatgtctgccaagcaaaatttcgtctattttcggcatgatttgcgttttgacacctgtttgcgcacacgccttgtacatttcctgcatctgagtgacgctcaaagatggaatggcgatgatgatccggtcgatattccattgccggaccgcctgcataatctgctctttcccgcctaagacgggcagacccatgatttcaagccggtatttcgttttgtcatcgtcgataaaggcgacgggcttaatgttcaattccggcttctgcacaagctgttttgcaatcaaactgccggcagagcccgctccgatgataagcgcccttagagatcctttgctttctttgttcacctgttccctgatgatgcgccacatcatccgcgatccgccgatcaaaatgagctggaacagccagcttaaacataaaagacgaaccggaacgttttgaaagaaaaacagctcgagggccgccgtcacaagatgggacaatgtaatcgatttaagcagcacatacaattcaccgatgcttgcatactcccatacttttttataaaggtggaagcaatgggcgaataaatgctgagcgccaagcagtatcagtgaagtcatcagcagcatttccgaagggtataaatcatatgatggcaaaatcagctgatatccgataaagatggacagcaaaaccaagtacgaatcgagtgcggtaataatggaaagccttctccgatatgtcaatttcctacctcctaatgtatctttctagctgataggatctttcagggcaaaatcccatgagctaaaaagatacgggcgattttcaaatttaaaccgagcacgtaaattaaataaagatgggcatttaacccgtcctcacgccccgccatcgacgacttgcgtctaaggcagacaggtagtctgcccacggtagagccgagtgcctccatcggtaaaggcaaggagacatcacctaaagcggctgcagccgcttcataagattacatggttgcgtaattatattggcgcgctttcttcactttccgcccgttcagcacggcgccgagcagttcgcttttggaagaattcagcgcgtcccgagacttgatcgcgttatcaagctttgtttttccgctgaggatgacaagaatgcttccatccacctgattcgccaatatttgcgcgtctgcgaccggcaaaagcggcggcgaatcaaggatgactaaatcgtattggtcgtacgcttccgcaagcaggtcctccatcgcctgcgacgacaaaagctcggacggattcggaggaatcggaccgcttgtcagcacatggagattttccgcctggctttgctggacgacattttccagcgtcgattttttcattaatacatttgtgacgcctgaatggttatcgagctcaaaaattttatggatcgtcggctttcttaaatctgcgtcgatcaaaaggacctttttttcctgttgcgaaaatacgatcgccaagtttgaagccgagaatgatttgccttctcccggcaggcccgatgtaatgagcaatgacttgaacggcttctcaaatgatgaaaactcaatgttcgtcctgatcgtccgatactgttcgacgatcggcgtgttcggctgatgcaatgcgacaagcgccgattgatatttgcgagagcgtttttttctaatacccaagcggctcactccttcctgcttttacgcggatattcatatcggggtccccgcgaaacagactttttttatgcttcatttgctcaatacttcccaaataaatgaatcccgcttccttttcgacttgagacggtcttgcaaccgtatcatcgataaagtccaaaaagaacgccaaagcgattccggtcattaatgcggcgccgaatgccagcaaaatattcattttgtaattcggtctgacaggtgtcggcgaatcgactatttcggcttttgacaggacggttacccgatcggtgttcataatttgcttaatctcttttttgagcaccgcagttaaagtgttcgctatatcggccgcccgtttctgattttcatcttggaccgaaatatttataatctcagattcgctttcactgctcgttgcaattttttcacccaaccggcccgcagagtaaggtaaatcaagctctctcttgacttgctccaaaatcaccgggtttttcaaaagcgcttggaatgtccgtgtgtattgaagattgatttgaatatcgctgtatgtggcgctcccctttttctcccctacttgatgcaccaagatctgcgtcgatgcctgatagacaggtgtcagcacatagaactgaatgattccggtcgtcaatgttacacctattgtcaaaacgagaataagaaccgttctttttcgcaagattgcaatcagttctctaaaatcaatattttctttcatgcttgactgcctcctcaggaatgccgtttgttaatgattggattataaaagaaaaaatttgaattgaaaaatgctgaatttagctatatagttctttttagagaacaaattcgttcgttttcttttattttctgtcgatatcttaaatttttgaattttataaagaacaaattatttcttataatgaacaggaaagcgttttatatgaatggcaaggggaaggggaggattcagtatgatcggaagagtcatccgaatgtacagaaagagaaaaggctactccattaaccagcttgctgatatagcaggcgtatcaaaatcatatttaagcaaaattgaacgcggcgttcacagaaatccgtcagtcgaattcctgaaaaaaatctcccgggcgctgaaagtcgaattaaaggaattgtttgataccgaagtgatcctttatcgccggactgagcaggaagatgagtggagaacccatcttgtacaggccgtgcaggccgggatgaaccaggaagaactgtttcaattcacacatcgcctcaagcagaaaaagaaagaacgggcgctttatcgaaacagagagctgacccgggcgaatatcgacgaatggagagcccttatgctggaggccaaagaaatgggactgaccgtcaaagaagtagaagcgtttttgatgaggacaaaaaatcattaatttatcctgcattcatattttttttagaagaaaacgggtgcttttgacttgaaccattcatccggatataaatccacatttccatttcaacttgccgaaaattcggaataatcgcattaatagatatcgcccgatcatgatgatccatgtctatagctccgttttcacctgtttgccttattttttcatggcagtctttaagagactttttgcttatgtttatatataaatgaagaaactcggattttgacctttcgcatcatcctccaatgcatgcaaagtctgtgtcttgcggcttatatcaagacctttgtcacggcccgattccttgaatggggacggagcgtttttgttgaatccgcgctggctgttcgttaagatgaataaaatggaagaaggagatgaaatcatgaaagtattagtgctcgcatttcatccgaatatggagcagtcagttgtgaacagagcatttgcagacacattgaaagacgcaccgggcattacattgcgcgacctttatcaggaatatcctgacgaggccattgatgtggaaaaagaacaaaaactttgtgaagaacacgatcggatcgtcttccagtttccgctttattggtacagctcgccgcctctcttaaaaaaatggctggaccacgttcttctctacggctgggcatacggaacaaacggcacagcgcttcgcggcaaagaattcatggtcgctgtatcggcgggcgctcccgaagaagcctatcaggccggcgggtcaaatcattatgcgatcagcgaactgttacgcccttttcaggcgacaagcaacttcatcggtactacataccttccgccttacgtcttctatcaagcgggcacggccggaaaaagcgagcttgctgaaggtgcgacacaatacagggagcatgtgctgaagtcattttaaatgagaaaagcccggcttatgagccgggcttgttccttatacttgaatctgtttcacttttcccaataggaatagataatttaaaatggcaatgatgatcaaagcagccgaaaaaaggagcgccggcacgaaagaacccgttgcgccaacgatgaagccggtaatgatgggtccgaccactccgcccatattagagactgtattttgaataccggcaaccatcgacgtcatatttttcggagccacatcccccggaagcgcccagacttgggacgcggcgacagtcgttcccgatttcgctacacaaagaaggatgacagccaggatagcggaatctgcaaaagcggcaaaaccgatgcacgaagccatgacaagcccgataattaaaaacagtttccggacggctgtcagcgacagttttccctttgcatatatccggtcggacatccatccggctccgacttcgacgaccattgcagtcaaaagcgggagagacgccataatccccatctcgattaaatccatgcccctttctttaacaaggtatgtcggcagccatgtgataaagaagtaagaattataattgatcatgaaaaatccaatgcacatcgcccatatgttgcgatatttgaatagctgataccacttcagcggctggccgccgcccgtttcttccatgtgagcctgcccttcccgaatatgggccagttccgcctcattgacgcgcttatgatctgcgggattctccttaaagaaaatcatccagacaattccccacgcgacaccgacaagtccgatcaaaagaaacgtcagtttccagtcaaagaccgctatcatccaggcgatcaaaggcattgcaacagctccgccaaactttgacccgctgtcaaaaattccggctactgtcgccctttcttttttcggaaaccatttggcggcaatccccgcattgctcggatatgcagcagcctctccgactcccagtgcgacccgcagcccgagcagggatttgaagcctgtcgcaagacccgtcagcgccgtagcaacagaccaccaaacaaccgcaaaaccgagcgtttttttctgaccgtacttgtcggccgcccagcctgaaggcagctgcagcaaagcgtacgaccagaagaaaccggacatgatgattcccatttggccgggtgtcaagttgaactcctcggtaatatagggagcggcagccgaaagaactgtccggtcaatataattgatggcaatcgcagcccacatcataaacgcgacaacccagcgtacatttgactttttttgaatcgggtgattcaacatgttatccacctcatcccatttgtagaaaacgctttcaaatcatgatgcagggcatgaatgaaaacacattcacaacccgttgacgacaaactccggtttttgtttgtcgatcagtacactagcgatgtttttgacgcatatcatgccaaggttctgtacggcatctcgggtataccccgcgatatgcggcacggcgataaaacggtccagctcaaagagagggtgctgcttcagcggttcggtttgatacacgtcaagcgcagctccagcgatgcccccgctcgccaaggcatcatataacgcacactcggacacgatgcctccccttgaagcattgatcagataagccgtttctttcatagcggctaattctttttcaccgatcatgttttccgtttcggctgtgagcggcatatgaagagtgataaagtcgcattctttcaagagctgatcaagctctgtaaaatggatgtgatgatcggctgcgaatgcacgatcaggaaacacatcataggctaaaacagtcatattgaagccttgcgcccgtttggcgacttcttttccgatcatgccaagtccgacgatgccgagtgttttgccgtaaacgtcagatccaaaaatcctcggccattttcccagctttgtctccctgtcggctgcaggaatctgtcttgcagccgacagcatgagaccgaatacaaaatcggcgactgcatgcttgttggcgttgggggcattcgtcacccagacgttgcgctctttcgcagcgtgcagatcgatattgtcgacaccgacgccatgtttgcagacaatttttaaagaagggagacgatccaggacatacggcgtaatctggttaaacgccacgatcgcggcatccgctccttctgctgcttcaataaactgctcctcggttatatctgcaggaaggcgttccagcgacatgccctttttttccaaaaacaagacgggatcgtctgagtatttcgcaaatgacggtgatgtacatacgactttcataagatgcaccaaccttctttcatttttctacgatttgggcgccagctcagcggctgaccgcaaagcagcgagcatgcttctttcatcggctttgttctgccccgcaatgtcaaatgcggttccgtggtcgacagaggtgcgtatgatcccgccgtttaatccgactgtaatgttgacgccctcttccaacccgaggactttgaccggtatatgcccctggtcgtggtagcaggctacgacaaggtcaacatctcctctgacagctttgtaaaacagcgtgtctgcggggtatgggccgccggcatcgattccctcagctgccgcctgctcaatccccggaagcaattgccgttcttcctcgccgcttccaaacaggccgttttcccctgcatgggggttgattccgcaaacagcaattttcggctgttcgaatccggctcttgtcaatgtatcatgtgcgagacggatgactttataggtccgctccggcgtaatcgactgaatcgcctcgatcagcccttgatgcgttgtcaggtgaatcaccttcagctttggcgaagccagcatcatgctgtagtctgttgtattcgttaaatgagcgagaatttccgtatgccccgggtatcggtgtccgcctttatgcagcgcctccttatttaacggcgctgtgcaaatcgcttgaatacagccttttttagcgagctcaaccgcttttttcacgaaatggaaagcggcgtttccagcttcagccgacacctttccgacaggcaggttttcaggcagcagttcaatatcgagacaatcgatctttccatgtacaaaaccgccctcgtccggatgcccgaccttgttaataacaacctctgatccgatttggaaggcggcttttttcagcattttcatatcgccgatgacgagcggcctgcacatatcatacacttcgcgggacgtgagggcttttacgataatttccggaccgacgcctgccgcgtcgcccattgtaatgccgataaccggtttcttcattgtttatcctccttgtagcttgattgccgcacttgccatcaccgaacgcgagccaaaatttccggcctttgtcacaatgtacaattcttcaccggctgctcccagcggaatgccgggctctacttcgtccagcaatcgtatctcatgaatccgaagctgatgcagcacttgatatgccgtgtcacctccggttaagaacagccgtttcacatgaaaagcttgaatcagctcgcccgcaaattcgccaagtgcaccggacaccgcattgctcgtttgaactggggtgagtccgcggctttcaccaatcttctgtgtctctgccgcattgtctgaggtgcagaggacgatgtgtttcgaacggcgccggacgtccgccgccctttccttcagccgttcgaactcgtttcttttctcagctccgccgcacagcacgcgctctgatctcatttcaattttttcagccgcacgtccggcgaatagttcgtgaagctgttccctccccgtccgactcatgcttccgacgacaaacatgatcggctggtcggaagacggaacggtttgaccgagctccctttctttcagattgaacgctttgggcagacagctcatcaagcctgccgaaccggccaaaatgatagaatacggcaaactctccagaataagcgccagcccctgcagatcggattcgtgaaccgaatcggccgtcacatatgaaatcccctccgcccgaaagcgttccagcttgttgcggacatgcccgtgtccgcggcggatgtcttcatatgataaatgcccgctcttatttcgagtctgcttttctattaatctttgaatattcgactcggctacaggcgttttcggatcgtttgccgcttcggtttcttcaagctttacgccgttcacataatggatgccgccgataacctggcgtccgttttgagggtagccgggagcgatcagcacaaagtccggctgaaacacttcgtacatcgcttgaagctcggctccgatatttcctctcatcgtgctgtcgatttttttgtagacgatatcaaacgattgccgggagatgtgttcactgatgtttttaacagtcgccttcgcctctgcggctggcagcgatctgctgtccgtattgaaaataacgacgccttccgtttcccgtctggtgaattcggcgtcgagtttgacggaaacatccatcccgtaatgaacaagctgaccgccgcagtcgttcgctcccgtcaaatcatccgcgatgattgcaattttcaaatgtcttcatcctttagttgattagttttcgatagatgtcttttatattttccagactgagcggtttcggattgttatgaagcaggcgcgtcacttttgaagctgagtcggctaaatcgtccacgtcgcttgcggttacgccgaacgcttttaaatcctgaggaatattcagccgctccgtccactctcttattttctgcacaacggcctcagccgcttgttcggcggtcaaatcagatgcaacgattcccattgtttctgccgcaagagacagccgttctgtaatggcatccatattaaactccatcacatgcggaaggagcatcgaattggcgacaccgtgggaaattcggtatttccccccaagcggataggcgagggcgtgaacggcagcagtaccggcagccgtcagcgccattccgccatacgtcgaaccgagcagcatgttttctctcgcttgtatcgatgaaccgttttcatatgcttccacaatacttgccgaaatcaatctgatggattctaaagcgaacatatcgctgatcgggtttgctttcgtcgaaatgaacgattcaagcgaatgagtgaatgcatccattccggtagccgccgtaatcggttttggcaatccaagggtgatgaccgggtcaagaatgacaagtttcggcaaaagaagcggactgacgatgccgactttcaattcctcttctggaagggtaacgatcgcgttcggcgtcacctctgcgcccgtccccgaagtactcggaatcagcacggtcgggattcccggcttttcgaccaaatctgtcccgagcagctcctcgaccttttttgaattcgtttgcagcacggacaatattttcgttccgtccaaaacgctgcctccgccgattccgatgagaatgtcgtatcgtttctcacggatgcctctaaatacgtcttcaatattttgtacggtcggttccggcaatatggctgtgcaaacatctgactgaatgccgatctctgtaagctgagcctgtacctctccgatcgcgccgagcttgacgatcgacggctgggtaataatcagcgccctgtccgccttcggtacaatcgttcgcacatgatctttcagccggcggatggaatgttcacctgcaacgatatgaccggctgtccgaaattgataattcgctggcattcttgaaacctccctattttgattgataggaagcaaccattttttcgacctccaaaagcgccggaccggtcagttctttgacgggcgctttcggcgggcctacagggatcgaataaagctcaaccgcttttttcagtgccgccgggatcgtacctaaacgaaacgtatcgcgaagcggctgaagctccatctgggcagcctccgccttttcagtctcaccctctgcccaatggtggtaaatagacgttacgatatccggaagcatatttgctgttgctgcgactgctcccgctcctcccgcttgaagcgttttcaatatgagcgaatcggtgcctgcaaaaacggaaaagtcgtcatttttcgtctgctcgatatactgttgtatgttttcaaagtttccgctgctgtccttaattccaacgatattgtccacttttgcaagctctgccactgtttctggttctaaatggaaacctgtttttgaagggatattgtacaaaaggatcggaagtgaaacggatgccgcgattgttttataatgcaccgccgcttcttcctgtgtcggtggaataaagaatggcgtgatgaccgacagcgcatctgctccaagcctctctatttccttagaaagccagatcgcttcttctgtgctgtttcctccgctccctaccatgacgggaacgcgttcggccgtttcttgaatgatgatttctgcaactttcagcttgtcttcgatgttgaacatatgaaattccccgttggtacccaacgcaaaaagcccgtgtacatgagcatcgatcaaatggtttgtcagctgtttcaatgccgattcatcaatgctttgatcttttgtgagcggtgtcagcatagcaggataaatcccctttggtacgaatcccatgattgcctccccttcctataaagcgttttcaaaaatgattatatacataaatgtttcaataatcaacggtatttatctaaatatttttatttgttgttgcatattaaaacaaaaaataagacaccggtttagccggtgtcttatcaatctgacgatttcaattttctccaaagcgtcgttctgttgatgccgagcctttccgctgttcttgtttgattgttcccttcttcggcatagatcttttgaatgatccttttttcgatctcttcaagcgttccggataaatcgatgtcttctctttcttcctcgttcaagcggctcaggacccgttcggcgtcagtcttctcgatatatacgccctgcgcttcaaggacacagttttggaccgtttttctcaattggctgaggttgcccggccatttcgcttcttcaagcagaacaccagcttcgtttcgaaagccgacgatttgtttgccgaatgcctcattgctttccgcaataaacagataagccagatgcaaaatatcctcttttctttcggaaagagggggaacgtccagttccaaatgacaaagcgcatcatataaatcgcttgaaaattcctcggcgcgcctgcgggaagaagaaacgatcagcctcggcccatcatacggttcgctgatccgcctgagtaaaagccgttgcgaggacggcggcatgcgatcgacttgtttgatgtatagcgttcctctccctgaaaagaattcttcgctttcacaagcctgttcccattctgcttcagacagcaaaccggcatcgatttttcgaaacggctcatgcttgtcctcccccttcatatggatcagcccggccaagctctctttccctgagccgggcgctccattgatccatacgggttcccgccttgccgagaacaactctgcttttttcagcaccttctgcatcgtttcgttccttgatgtttccatataactcatccgcaaaggagaaagaatcgttgccccgggcaaagaagaaacgcgaacatcttttgcattttccgcggtaaatacggtcaatgcctcgtctgatgcgaaaaacctgcgccccgtgatattccatgtccgcccatgctttcggagtctaaaatggatgactcccttcttttccgcttccccgatcagctcttccagattatccagcaagccgatatgttcggcaaatacgccgttttgaaaaaccggccgcaatgtcttgttgtatactgcataaccggtctcggccttttgtaaaatgtgatacggcacagcgtacttctgcttgatgctctctaaaaaggaatacagttttttagcgtatgcaaaagctttggcaatgctttcttttccggatgtcaaaagcagtccgtttaaaccgagctgctctgctttctcaattgtgatcacatcgccgataatgatctgatagccctgttctttgagctgaagaagcaccggttcaacatcgcgttcgtctgatacggtgcaggcgtcgatccgaatatccaaaatttcgcacaccgccgatgcgccgtcggcaatcatcggaaatccgacaattgccgccttgccgggatagcccttggcaagcgtaagcacacgcagcatatcgtatcccgacacttcgatatccacaaccggaatggaaacttctcgctggatcagctcagcggttccacctctgctgataatcaaatcagtcccgtttgcttccgcttgtttcgccagctccacgcccttctctaaatctccggaagccgcctcgaattcaaaattctcgccgcctgccacttgaaccatcagctctttcagtccttcatatggagcaattgccatcactttcatattcgatcaccttttgttgcaaatttaaacacattatcactataccaaaaggcagaaatatttggaaccgcaaaacgaaggcaaaataaaaaggctccattacggaagccatttccccccccatgcggccatctctttaaaaatgctgtggaactctttacctttttctgttaatttatattctacagtaacaggaaccgttgggaacaccttccgggaaatcatgccgctttcttcaagatgtcttaatgtgtcagttaatcctttcgtgttgacgtttcccaagttccttctgagctcgttgaatcgccgcttgccctgaatgagttcggcgagaactaaaaatgaccatttaccagagaaaattttcaatacatcctgaattaaagaagagcattctttatgatcgacagctgaattcatagcaattcctccattgcctcatagccaattttgacttgatcctaccatatggacatcagagcattcaagaaaacgatcttacggtttatttttataaagcatatataaaaaaattgcgttcttgtggagccttccggcggttgctatggttatatcaaaaggaggaaaaacatgaaaaaacaatacgagtctttattcaccccgtttacttttaaaaacggaatccaattgaaaaataggatcatcatgccgccaatggggcattcatcctcattgccgggaggattcatttctgacgacgaactggtctattatgccgcgcgggcgacagaagtcgggatggtcatcacatctgcgacaaccgtacagcccggaaccggatttccaggcatccccggagctgagaacgatgatcaaatccctggactaacccggcttgcagccactttaaagaaacacggagcaaaagcaatcctccagctcttccatcctggagccaaaggtatagagcggacggtcagcgccagcgccgtcgctccgaatcaaccgaatgcaccggtgccgagggcgctgtctgagcaagaaattcaagaccttatccattctttcggccaggcggcgcgaagagcgatagaagccgggtttgacggagtcgaaattcacggcgcaaacgggtttctcatccatcagttcttctctccttattacaaccggcgcaatgacagctggggcggcactttagagaaacggatgagatttccgcttcagattatagaagaaatcagacgcgtagcggatagctgccataagccgtcctttatcatcggctacaagttttcgcccgaagagccggaaacacctggaatcacaatggatgaaacgttgtctttcgtcaatgtactgcgggagcaaggattggattacctgcacgtatcactggttgatttccggtccttgccgcgcaggggtgcagacagatcccgcgcaaggatggaactgatcaaagaagccgtccaagaccgtctcccactgatcggagccgggcaagtacacacaccggaagacgcccttcaagcgctggaaacaggagccgatctcatcggaatcgggcggggtctcctgatggatccggagtggctacaaaaagttcgagccggaaaagaggacgatattcaaacaaccctgtcaagacatgatcagcggaagctcgcaattccagatgccttttgggaaagtataccgatgtatattgatttcagcgattgacgattcccgcttatacagactatagattcatataaaaaaggtgtctttccgcttaaaatcggtgtcatttgcataaaaatgtataggaaaagaggaacttagaccagttgagtcccagagatgagtatattagaatgatggtaattcaatatcgtcgggattgttactgtctaagcaggcaagacctaaaatgtgtgaagggcgaaatctatcttttgcctatatgaacttgcacattttaggtcttttttctgttcttcaggacaatgccgcagttaggagggatgattgggaacgttcatgttgtcagaagcaatctattacatattgaaaaagggaggaaatattgatgaacatcaaaaacattgctaaaaaagcgtcagccttaaccgttgctgcggcactgctggccggaggtgcgccgcaaacctttgcaaaagaaacgcaggattacaagaaaagctacggattttctcatatcacaagacatgacatgctgaaaattcccgagcagcaaaagagcgaacaatttaaagttcctcaattcgatccgaaaacaatcaaaaacatcccttctgcaaaagggtataacaaaaatggagagctgatcgatttagacgtatgggacagctggccgctgcaaaatgccgacgggacggttgctacataccacggctacaatcttgttttcgcgctggcgggcgatccgaaagacgtcgatgacacatccatctatttgttctatcaaaagaaaggcgaaacttctatcgacagctggaaaaacgccggcagagtgtttaaagacagcgacaaatttgttccagacgatccgtacctcaaacatcaaacacaggaatggtcaggttctgccacgctgacaaaagacggaaaagtccgactgttttacacagctttttccggcacgcaatacggcaagcagacgctgacaacagctcaggtcaatttctctcagccggattcggacacgctcaaaattgacggtgtagaagatcataaatcggtctttgacggcgccgacggcacggtataccaaaacgttcagcaattcattgacgaaggaaactacagctccggcgacaaccatacgatgagagacccgcattatgtggaagaccgcggccataaatatctcgtatttgaagccaatacgggaacaaaaaccggctaccaaggagaagactccctattcaacagagcctactacgggggcagcaagaagttctttaaagaagaaagcagcaagctgctgcaaggtgcgaacaaaaagaacgcttcgctggctaacggcgctctcggaatcatcgaattaaataacgattatacactgaaaaaagtcatgaagcctttgatcgcctccaatacggtgacagatgaaatcgaacgggccaacctcttcaaaatgaatggaaaatggtatctgttcacagattcaagaggatcaaaaatgacaattgacggcatcggttcaaaagacatttatatgctcggctatgtatcaggttcattaaccggaccattcaagcctttaaacaaatccggacttgttttgcatatggaccaggattacaatgacatcacgtttacttattcgcactttgccgtaccgcagaaaaaaggcgacgaagtcgtcattacaagctacatcacaaacagagggatttcgaacgagcatcacgccacgtttgcaccaagctttttgctgaagatcaaaggatcaaaaacatccgttgtcaaaaacagcatccttgaacagggacaactaacggtaaacaaataaaacgaacgaaggaaaatgccggtgaacatcggcattttctttcgtatgtcatcttagaataaagcggggaattttcttgaagaaggcagtatataagcggatcagcattttaactgtttgtcttggaatcttcatcatgatatttctttcagtccgggaaacagaaaaaaagggagaatctccggatacaccggaatatcgtgcagctttccatttgacaacccctgacaaatggaaaaacgaccctcaaaaacccgtctatttcaatggagaatatcattactactacctctataaccgagactatccggacggcaatggaacagagtggcgccacgcagtatcagatgatctcgtcaactggcaggataaaggggttgccattccgaaatatacgaataaaaatggcgatccctggtccggttctgtcgttgtcgactcaaaaaacacagccggcttcggcaaagggacgatcgtggcggttatgacgcagccgtcggccaatgacgggaaggaagagcaatttttatggtacagccaaaatggaggaaaaacatttaaaccttacggtgaagagccggtcttgcctaatccgggcaccgtcgatttcagagatccgaaagtgatctgggatgaacaggatgataaatgggtgatggcgctggctgaaggaacgaaagtcggcttttacgaatcgcaaaaccttaaggaatggcgttatacaggtagttttcaaacagaaaatatcggcatcatcgaatgtccggatctgtataagatgcgggcggatgacggaacatataaatgggttcttggagcaagcgccaacgggaaagggaccggcaagccgaatacttatgcatactggacaggcagcttcaacggcaacgaatttacggcagacgaagcagaaccccagtggcttgattacggatttgactggtatgcgggcgtgacatttgaggacggcgaaacgaacgatccgtacgagaaacgctatgctttggcgtggatgaataactgggattatgcaaaccggacgccaacatggaaagacggttttaacggaaccgattcgatcgtccggcaaattcggcttaaacataaaggcggagatcgatacagcctcgcctctcatccaatcgatcaattggatgaattaaccgaatctgccgatgaattggatcgcatcgaagtgaacggatcaaaaacgctgcagattaaggggaatacctatcagcttgaggcagatatctcttgggacgaccttaaaaatgcgggtttcaggctcagagaatccgcggaccgaaaacgccatatcgatgttggaatttcggctgaaggcggatattcttatgtgaacagaggatttacgggacagcctgacagcacccgcacctatttggaaagcaaagcaccgtttgatccggaaaaaaaacgggtccatttcacaattatcgtagatcaaaacactgtcgaagcatttattgatgacggcgaaacgacgcattcaaaccttgcatttcccgacatgaatgatacaggcatcacactctttagcgaaaatggaacggccgtctttgaaaatcttaagatcaaacatttgcgttcaatccgcgattaaacaacacgggcggccaagcggccgcctttttttgtgaaagcgaatcattacgctcactctccgaatacgactaaagtgttcacaaaaaaacaagggcggcaaatgccaaacccttgtcttgaaaacgcgctcggagggattcgaacccccggcagacgtggtaccggaaaccaccgctctatccagctgagctacgagcgcacaatatgattttttaacgtcagcaattcatattataagggctgttctttaaaaagtcaatcacaatctcctgctcgaaacaaaaaacccgcatcatcatgatgcaggtttagataatacggaagctataatcttttgttcgatttcttcatttacttcgtccgttgttttgacaaggcagataatgccgtcaataaaaggccaaatgaataatgtaatccagccgagaagcaacatggctacagcgtagccttttctctcgtccagataaaatctgtgagcggcaacgcctccgagaaaccaccataaaagaaatacaatcagcttcgatttcttcttattttgcagctctgaagccacgacaagcctctgctgatctgtcaggttactcttgtccaagttcacataacccataattgatttccttctttcctataaaataaaatgaagaccaatggactaatcttagactattggacctaaattttctatacttttctctataaagttgatattttgtttgagtttccttcaaaatgggaaaaataaacccagtatgtcttttggatgaaggcggctttttgtttgacctttattgaccaaaaatgtatgattaaactacatacttaccttttaaggtgaaggaggagcattatgaatttaatacctacagtcattgaacagacgaaccgcggggaaagagcgtatgacatttactcacgcttgttgaaagaccgtatcattatgctgggatcagcaatcgatgacaatgttgcgaactccatcgtatctcagcttctattccttgaagccgaagatccagaaaaagatatcagcatctatatcaacagccctggcggctccatcacagccggtatggcgatttatgacaccatgcagtttattaaaccgcaagtctccacgatttgtacgggaatggcggcatccatgggtgcgttccttcttgcagccggcgagaaagggaagcgctacgctcttccaaacagtgaagtcatgatccaccagccgcttggcggagcgcagggtcaggcgactgaaattgaaattgccgcgaaacgcattctttcattgcgcgacaagctgaacaaaatccttgcagagcgcactgggcagccgcttgaagtaatcgagcgcgatacagaccgcgacaacttcaaaacggctgaagaagcaaaagaatacggcctgattgataaagtgcttacacgcaatatcgacgcacagaagtaaacagccaaaaagctgccggagtcaccggcagcttttttttactccaaatgggttgtcccattcgctatatgtaaagcttctataaatccttccactttttctcgaggacagggtagcgataatcattcatgttcccgatcaactccgcagggcttgccgaagcatgaatcagctcaaggtgcgatttgttcgaaaagccttcttgaacgctgtattcgagcattttaagaaggggttcaaaatagccgttcacattgtaaagtccgatcggcttttgatggatgccgatctgcgcccagcagagcacttcaaacagctcttcaaacgtgccgaagcctccgggcatcgcgataaagccgtcagctaattcactcattttcgctttgcgctcatgcatgccgctcacttcgatcagctccgtcaactgctgatgaacgatttcccctgtaaaaaggcctttcggcataacgccgacgacttccccgccgttttccaatacggtatccgcaatcacgcccatcaatcccattctcgatcctccataaacaaggcgaagccccttctcggcaatataaacgccaagctctgcagctttcttcttgtactccgggtccgcccccatatttgatcctgaatatacgcataccgttttcactttcgctcactccaactccatatattgataaaagcaattaacattgtactatatattgtttgttccgtgtgcgacaatataattgaatttctaaacgggagtgtataacttatgacaatcacagacgcggagcaatggacaaaggcattttacagggaaagaggatggagcgaatacggacctttcatcaggatgggatttttaatggaagaggctggcgaactggcgagagcggttagagcatacgaaatcggaagggaccgtcctgacgaagcaaaacggccggctgctgaactgaaaaaagaactgatcgaagaaatgggcgatgtaatggggaatttgatcatgcttgccggcatatacggtgtttcattggaagacatgatggatgcccatcgctgcaaactgacggaacgatttgcaggagagcatcatcaagatcaatgaccgcctttacggggaggcagatttggagcctgtgctgacagacctcattcgttcaaaagccgttcagcgtctgaaagggattcatcagggcggggcctcttttctcgtcaatcccgcatggaacatcagccgctgtgagcacagcatcggagttatgcttttgatccgcaggcttggcggaagcctggaagagcaaattgcaggtttgctccacgatgtttcccatacggcattttcccatgtggctgatgatgtatttaacatggaaaacgaagattaccatgaacagatgtttcggcaatgggtcaagcaatctgatatctccgggattctgcatacatacggattccatgatgaagacatcttatatgacgagcaaaaatggacgctgctggagcagccggctccttcattatgtgcggatcgcatcgattacacgcttcgcgactctttagcctatggatttggcgatccggtagagattggacgatttttagaaactggattgaccgttgctgaaggcgaaatctgctgcacttcggcagagcatgccgaatggttcgcccgcctttactatcaagaagtgattgacttctttatgaatcccctcaatatatatgcgctctgtaccctcagccaaatgctgaaagaggcgcttgacatgcgtgttattgcggggcgcgattttttcaaaaccgacacggaactgcttgcgatgctaaagcaaaaagcgcgcttccgggaaacgctggtaaagctcagcacagcgagcaagcgcgttaaacaaggcgacgaaggcgattttacttttcatcaaacattaaaggtgagatggatcgatccaaaagtcgctgttaacggaagaaaaatccccgcctccacactttcaaagaacgtccttctgatgaaagaaacggcaatagccgccatgaaaaaaggcgcatatgtaaaagcagcccaataaaagaaaccgcctgcttcagtccggccgaaacaggcggttttcttggttatgtcacgtcaaatatttgttcaggcctgtcgacaaaatgctttttgccgatcttatgaaacagccctgttttatgaagaagctcacgcggctgctgctgaagacccacgatcatcactttcccgttttgctggtggacacggttgacgatcgtcatcaggctgccttctgcggaagagtccatgtagtctactttattcatcagcaggatgaggagttttggcgggtggcctttgtccaaaattgaatcctccaatgaattcgatgagccgaaaaacagcgggccttcaaccgaatagatgctgacagagcgttgaaaatgcttttcttccgctgcagctgccgactggacgatcgattcagacacatcttttttaatgcggaacgacttgctcattctggcgataaaggtgatgatcgccagcaggatcccggccgccaccccaaacacaagatcctgccaaacggttaaaagaaatgtgacgacaagcacggcagagtctgaatttctaattttcaaaatatttataaactctttccgctcactcatattccaagcaaccaccatcaaaatcggcgacatgcttgcaagcgggataagggaagcgtatggcgcaaacaaaagcagaaccaataaaacgaacacaccgtgtacgatacctgaaatcggagaagcagcgcccgttttaatattggtcgccgtacgggcaatcgcacctgtcgccggaataccgccgaacagcggtgcggcgatgttcgcaattccttggccgacaagttctttattgctgtcatgccttgtccccttcatattgtctgccaccatcgcggaaagcagcgattcgattcctccgagcattgcaatcgcaagagcgggaggcatcaggtaaatgattttttccaatgacaactcaggaaattgaaagctcggcaagctgcgcggaatttcgccgtaagctgatccgatcgtcaccacctgttcgggaaacagcatcgtggccatgaccgttgatacaagcaagcctgcgagcgctcccggcactttcggcagaacctttggcgtaaacagcacaaagaagagcgatacgacagccgtcaaaatgctgtaaaagctgagcgtattcaggttgatgacaacctctctcatattcatataaaaactctcatgcttctcgacatttctcaagcctaaaaacttggcgatttctccggtgaaaataatcaccgcgattccggccgtaaatccgatgatcaccggccgcggaataaatttgatgatcttgccgagttttagcagccctaatatgaccagaatcactccggccataaaaccggcaatcagcagattctcaaatccgtattggagcacaatagcgaacaggatcgggacaaaggcccctgtcggtccgccaatctggtatttcgacccgccgagaagcgaaatcaaaataccggcgacaatcactgtgtaaagaccgtgttccggtttcacccccgaggctatagcaaaagccatgccaagcggaatcgcgacgactccaacgaccattcctgctacaatatctttttgaaaccgcttaaggctgtatccttcaaatctgcctgaaaatcgtaacattcaatctatccccccatttgatcatcgcacttccgaaagcgaaacgtcttcacgtgaataaccatcttcaacaacatccaaacggccggtctttggatcaatcaccaatccgtgcaccggaacgtctgaagacaagagcggatgtttccggatcatgttcacactgtggctgacgctgtcttcaacgctgtcaaagcccgtcatccatgtgtccaaatcgatgcccgaatgctgcaggagttcgagacagccatcatcgacaccccgctgtttggccttttgaaggatagatgaagcgttcaggcttgccattccgcactcatggtggccgatcacgcagacttcttcagcctgcagctcatagacagccacaagaatgctgcgcatgacgcttccaaaagggtgagaaacaacggctcccgcattcttaatgatttttgcgtctccattttttaaacccattgcatgatggagcagttctaataaacgcgtgtccatgcatgtcaaaatcacaagttttttctcaggaaatttcgtcgtttcgtaaaactcgtaccccttttcctctacaaaagactgattgtgcttcaaaatggaagttaaaatcgccatttttctctcactccttttcatagtcatatgaccttgatattgttacagccgaattatagcacatggatttccgctttggattcgaatcaaaaaattcactaaaaatgtactgaatatttttaaaaatctaattttatatctttctaaaataataaaatgtacgctgttcttcacctataaaaaaataactggaagcaaaatggaatatcaaatatttggatttatagttataaaaatgcattaaaataaattaaaaaactgaaataagattctatgattttctaaataacgataattgagctgatagtcctgcgctagctggaacaatctttgatttttacagaaaccgtttttcctctataatggaagcagatgatacgcggaaggagaatgcagatgaaaccgtttgtatatgtcacaaaaccggtcccaaaagaaatcgaagagatgctcgctgaacattgcgaatatgaaatttggacttcacgcgagcgtattcccagaacgaccctgctcgagaaaatcaaggaagcggacggccttttgacctcaggaacaaaaattgaccgtgaattattatccaatgcactgaagttaaaaatcgtcagcaacaattccgtcggctatgacaactttgatattgaagcaatgaaagaaaaatcggtcatcggcacccatacgccatatattcttgacgacacagtcgcagaccttgctttcggtctgatcctttcctcagctcggcgaatcgccgagctcgaccgctacgtccgcgagggaaaatggaccaaatcagaggacgatgaaagcttgttcggatctgatgtccatcaccggacgctcggcatcatcggaatgggacgaatcggcgaacaagtcgccaaacgggcggccttgggttttgatatggaagtgctctattacagccgcagccgcaaacccgatacagagaaaaaaaccggcgcggtttatacgggctttcatgagctgttggagcgctcggatttcattgttctggtcacaccgctcacggatgagacataccgcctcatcggcgaagcagaattcaaaaaaatgaaaccgtcgtccattttcatcaacatctcccgcggtaaaacagttgacgaacaagcgttgattcaagcgctgaaagaaggatggattaaaggagccggacttgatgtatttgaaaaagagccgattgaaaaagacaatccgctcctaagcctttccaatgtaacccttgttccccacattggatcatccacccatgtcacacacgtcaacatgctgaaaagcgccgttcaaaacctgattgacggtcttcagggcaaacggccaaaagatatagtcaaagaactgagataacgcgcatctttcaggcgcggaacgttttgccaagctctcctcctaagccaaaatagtgtctgaaaagataaatcaaaggttcccatttttgaggatcgatgtggtgttccccttttaaaatcgcttcatgtgcgtgcacatgaagcacttttgtttcaatgacggcaaaatacggggaatgttccggaatgcgaatgttgacagcttccgcttcaatttgaagcgggcaatcggcgactctttcaggtttcactgccaaggaatccgcggccgtaaatccgccggcttcaaatttctccttaaggtaagtaaagccgagccgctttttttcttccggaacgaatcgtttgccggtataggaagccagccgttctacatttctccataaagatgaatccggcacattgataacgcatccagcatgcctctctaaattttccaatgctttaccttcggttccaataccgagtacgatcgaatccccgagcgcccaagaagatgacagcgggctgagattcgtggaaccgtcttcgttcattgtgctgagtaaaatgactggtgttccgtaatataaaatgcttggctgaataattttgctgttttgttccatatgcgtctcctccttttatgcttttattgtaattcttcaatatttcaattaacatcgaagtatcgattgcattttaggaggaagtgtaatgaacgtgaatccaaatatcgccgaggtcgccaagcttgtcaccgatccgtcgcgggcggcgattttaaccgcattgcttgatgaccggtattatacggctaccgagctggccggatatgcgggaatcaagcagcagacagcaagctttcacctttccaagctgcttgacgccgagatgctgacatgcaggaagcaaggacgccaccgctattacaggctcaaaaacggaaagattgcacaatcgctggagaccctgcttaacatagcgccccctgcggaaattcgctctttccggcagtcagctgaagatcgggcggtcagaaaagcgcgcacatgctatgatcacctggctggatcgctcggcgtcacacttgcggatcggctcgtggagatgggcgtattgaaagaagaagagacggcttttacagtgactgaagaaggggaagcatttttgaaagagcttggcatcgatgtcagggaagtcaaaaagaaacggcgctctttttgccataaatgcctggattggagtgaaagacggcatcacattgccggcgccttaggctccgcattgctcgatgccttcatccgcatgggctggatcgagcggcgcccgcatacacgggccgttgcagtcacgcccgccggcgcaaaggaactttaccgcctatttcatatttccattgaaaagaactgaagaaatagttctcgatcgttttccggcattccgggagaccaaatagcatgcggttaggaacctgcggcaagccgttcacgtcctcggctttcatggaaaatttacaataatataatgatttttgggcatgttttaaggtacaattcaagatgattgcagacggaatatggaaatgaagaaatgcggctgttcaaccccatgaaggcacattcttcatgtttatgttataaagtctaaagacagggaggactttatccgtgaaaaaaatattatcaactcttgcgctggggtttgttctcgcgctgggctttctggcggggaacctttttacaagctcagctgaagggccgcaggcagaaaaaggcggcaccgttcagtcaaatgaagtcatcaatacatttgaaggtgttgccgactatattgtgaaatacggcaggctgcctgacaacttcatcacaaaagccgaggcgtcaaaattaggctgggatccgcaaaaaggcaatctggcagaagtagcgcctggaaaaagcatcggcggcgatatctttcaaaacagggaaaagctgcttccagatgcatccggacgcgtatggagagaagccgacatcaactatacatcgggattccgggggtcagaccggatcgtctattctaacgacagactggtttataaaacgactgaccactataaaacgtttacgagaatgagatgattatatgaaacaagtcactttaaaaggagaaaagatcagaagtgtatcagatcttcacaaagaattaaaagaacagctggagcttcctgactactatggcgaaaatcttgatgcgctgtgggattgtctgaccggctgggtcggcatgcctttgctgatagagtggaagaatgtcgagaaaagccggatttacttgggcgatcaagccgaggcatatttgcagctttttcgcgaagccgaagaaacactggacggctttcagctgaaaacagaaggatgaaacagaaaacgagcgggcgcttcagacaggcgtccgcttatattaattgatgcagaaaatcggttcttcagtcaaaaaatgaatgaacgaaaatggtttggaaatctcctgcattcacatcctctttcgtcaaaccgccccctgtctgctttgtgaagtgatccttcgtcaaaattaactttccgtcctttatcagcttggaagcgagcgggtttttattaaaaggcgacgcctcctcatcgaaaattgcatcccgcacgcatgtaagcacagcttcatcgattggcgtcagcgaaaatgcatagccgatctgccacccatctcccttatccatttcaagaaggtaatctcctttatccgtctttgtttccctgacacggtaagctcctgtttttgaggggacaggttcacctgagaacggaacgggtgcaagcggcaggttgatgccgaatccagtgtccagcagataggtttcatcaccttcccgcagaattacggcgacatgcgttcccgtcagcgcccacgcctgctcttttgcattaaataccgttccgcggaccatgtgaacggaaaagccgagctctgtcagcacatagtaaagaaaagcgttcaaatcatagcataaaccgccccttttattgttcagcaaggcttccgtcagctctgttttcgtcatcgaaatccgttcgtttcttaaaaccgcgccattttcaaatggaaactgcaaagccagcagcgataaaaactcgggcaagtcggcaaatgtcacctgctgacctggcttgtatccaatcctcttaaacagcgaatcgagcatcgtcgtcatcggtaattctccttccgcttatcaatgagaaaaagccaaacctcataaaggtttagcttctttctcttgaacatatgcagtcagtgcatcaagggcatcttgttcatcggatccgtcagcgatcagcgtgacttccgatccggagctgacagcaaggctcatcagccccatgatgcttttggcattcacttttttatctcccttttccagaaaaatatctgattgaaaacggttggcttcttgaacaaacaatgccgctgggcgcgcttgaagccctgtttttaaaagaacttccactttttgttgaaccatacgatctcccccattccctattttaaagagacagattgtcctgaacgcagctgctcagctatttcatccagtttcctaagtcggtggttgatgcccgatttgctgatttttccgctcgacaccatttccccgagttcctttaatgttacttcctgataatcaatgcggagctgagcgatttccctcagcttttccggcagcgcatcaagcccgattctttcgtcgatcagcttgatgttttccacctgccgcagagaagcgccgatcgttttgtttaaattggcggtctcgcaattgacgagccggttgaccgagtttctcatatcgcgcacgatccggacgtcttcaaagcggagcagcgaattatgcgcgccgatcacattcaaaaactcggtgattttttcggcttccttcagatacgtgatgtatccctttttccgctcaagcgttttgctgtttaaatggaactgattcatgagcctgcacaatgaatcattatgctctttgtacagcgaaaaaatctcgaggtggtaagaagatgtctcgggattgttgacagaacccccggctaaaaatgcccctctcatataagaccgtttgcagcatcgttttttgactaagtcttcggagatgtttctggcaatgacaaagttgtctccgagtattttcaagtcctcgagaatcggcttggcattttcgatcaggcgtacgatgtagacattgttttttttcagtctcattttctttcgaacgagcagttcaacggaaacatcgtattgtttcttcagcaatgtgtaaattcttctggcgatggccgcgttctcggtctggacgtcgagaaccacttttcggtttgagaaagacaatgaaccgttcatccgaatgagggcagagagctctgctttcgcgcagcaatcctttacttcaaggtttgtaagttcttttttcgtttccgatgcaaatgacatattatagacacccccattccaaggcctgctattcttttaacaaatcaacaagtagcgaagcgactttatgtgtatcatgacggatcacgccattctcgtatgtcacaatctgatctttgatgacctcaagccccatcgcagacagatcatcaatattaaactggacgggctgtgcctgctccttcgcatagcgttcccgaatgtcgtccgggatttcctcattgttgacgaggatcgtatcgataaacggaccgcccatatgctggttaagcgcttttacatggtctgccgcactgtagtacagcgtttctcccggctgggtcattacattgcaaatataaactttttttgccggggcgtttaatatctcttcccttatcttcggaacgagaaggttcggcaagatgctcgtatacaggcttccggggccgagaataatcaggtcggcgccgcggatcacgtcaatcgtttccggaacgggttcgattttttcaggggttaaaaacacccgtttaatccgcttcccgtaagacggaatcgtcgattcccctgatatgatctgtccgtcatccatttccgcatgaaggacaacgctggtattggccgcgggcagaacccttcctctcacatttaagactttgctcatttcagtgacggcgtgaaagaaatcaccggttatattcgtcatcgccgccaaaatcaaatttcccaatgaatggccgattaaatcgccgcctttagagaagcggtgctggaacaggtcttcaacaagcggttcgacgtcagacagtgcagcgaggacatttctgacgtcccccggcgggggaattttcagctcgtcgcgcagcctccccgagcttccgccgtcatctgcgactgtcacaatcgccgtgatgtctaccggctgctgcttcaatcctctgagcagtaccgaaaggccagttcctccgccaaagattgcgatttttttctgatctgccatgctattttctgcttttcttctcgatgtcccggtgagtaacatgagtatagtagtcctttttaaaataatcggcaaggtattcagccagcgtcacagaacgatgctgtccgccggtgcagccaatcgcgatgacaagctggctttttccttctcgcttgtatgacggaagcataaagctcagcagctcggtcaatttttcaagaaacttttgcgtttcgttccatttcatcacatatgaagatacttcctggtctttccccgtcagcggcctcatgctgtcgatatagtacggattgggaaggaaccttacgtcgaacactagatcagcgtcgatcggcaatccgtatttaaacccgaatgacatcacattcacagtaaaggtatgtccgtgatctgccgcaaaatgctggacgattttttcgcgcaggtctttcggcttcatatcggatgtatcatagatgatttgagaacggcctttcagctcttcgagaagctcccgctccgtttggatgccctcaagcggcaggcccgttgtcgcaaggggatgggatcttcttgtctctttatatcttgaaacgagaaccgaatccttggcatctaaaaataaaattcgcggggtaatccaggatgtttccccaatttcatcaagcgcttcaatcaggctgtcaaaaaactcgcggccgcgcaaatccataacaagggcgactttgctcatttttgaacttgattccttcatcagctccaaaaatttcggcagcaaagatggcggcagattatcgacacagaaaaaaccgagatcttcaaagctttgaatcgccactgtttttcctgcccctgacattccggttatgatcacaagctgtatatcatggcctccattcgcgttcatgcttctctccccctcttatgtttattcgccttgcgggtcgaggcgataggacagcaattcaaagtcaggcgtatacgtaaaggtgccgtgaagcagtcctttgcctttcagcataaaatcaagaatatggacgtcgcccggcgccatcggcaagctaccgacgtcccccgcctgatgccacctgatgatgccttcttctgattcttctacatgcttgcctgtataatgatcggcgacgaatgtgaacatcatccattcagatacaacctgatcattttcctttatgataaaggtgaatattcctttcagctgcgggttcagcacatacaggcccgtctcttcgcggtattccctgataacggcgtccctgacggtttccccgctttccattttgccgccgggggccacccaccagcctcgtctgggcttttgcagcaacaggactttatcacctgaagtcagcacacaattcgtcactctttgcaaagtctgtcacccatccttttattccttcaattcttttttctattataccgtttcctgtccccgctcacaatgaacatgcagttccgccgcgaaaatcgccttttcccgggctgttttaggctttttccgggtaaaaacttaatgaaacggctttttcagcaaatggaagcgcttgcgaaaaccgttcttttattctattttacagcaaaaacgactgtttcaatattgaaatttgaacaacttgtgaaatttgtaaaaaattctctttgcaggaaaataagacaaaaaaaggacacggataagatcatccgtgccaataaaattcattataaaagggggtcaattactataccaatcataacgaataattgtttcactggtgttacaggccggttaaatcatgatgacgattaaaatgcgttattttacagccttttctttctctttcagctcttcgatatagtgctgaacgctctgtgcggcaatgcttccgtcccctgttgccgttacgatttggcgaagggttttctcgcgaatgtctcccgcagcaaaaatgccttcgacttttgtttccatctgttcatttgtcacgatgtagccctcttcatttgtaatgccgaggtttttgaaaggctctgaaagcgggagcataccgatgtagataaagacgccgtcagtccggaactcttcttcttcgcctgtgaccgtatcgaccagtgtcactttgccgacttttccgtcttgttcatgaatttccttgaccgtcttattccagagaaagtcgactttttcgttgtcaaacgcgcgcgcctgaagaatgctttgcgctctcagcttatcgcggcgatggacgattgttactttcgaagcgaaacgggttaagtacacgccttcttcaacagcggagtctcctcctccgacaacgaccagctctttgtttttaaagaaggcgccgtcacaaaccgcacaataagaaacgccgcggccgccaagctctttttcgccaggtacgccgagcttcttatattcggcgcctgctgtgatgatgaccgcgcgcgctttaaattcttttgatcccgctttgacgatcttatagtctccttcatcgacgacttctttaatatcgccgtacgcatactcagcgccgaactttttcgcatgttcaaacattttatttgaaagctcgggtcccagaatgctttcaaatcccggatagttttcaacatcctccgtattggccatctgtccgcccggaacgcctctttcaaccatcaaagtcgacaggttcgcccttgacgtataaacggctgccgtcattcccgcaggacctgctcctataataatgacgtcatacattttttcttctgacacaatgttcactccttcatgaatcttatgcttgcaagcagtgcattcctgttaaataagattcccttcttataacttccttacccatatcctataaaatatcatgaataatcgctatttttttgctcacataataaaacaggctgaacaatgaagttcacacctgtttctatagatgctcttttaatgtacgttcatactttgaaagcgttccgggcgatatttggaaaattttagcggtttcggcttttgtcaaacgctcctgatgctccgtcttccaaatgtaatagatcgctgccgcaagcccgccggcatttttcagctgaagcccgtaagccctgatctgctgaatgacatggaaaatccaaaagcacatggcctcctgctccatcgccgactgatccgcttgttcaatcgcttttgcagtcctgtaagcaagtagcgcgtcttttgaatcaacggctgcaccgatttccccgtaaagcacaagtctgacaaactgatcttcaaacggcgtttttgccatctgtgaatcaagcaccgctttcagctgggctttttccccttttcttccgctgatataatatgcggcaaggcgctcctcgagcggtcgctggacaggtctcttttccttccgttctttccacggctccatgcgggcgtcatccggatactcttcctgcatctttttccatacagaccgggcaaattgaacgcggcccgtgtaataagccgagcaggcgagccagtaataaaaggtctcatccccttcaaatcccatgcggtagagtgatttcagccatttaaacccgagatcgtatcggccgacaagggctagcgtggcaccgagcttatacctttgctcaaaaagcatcggataaatatttgaaagctgttcggaaagcgcatcgaccttatcgtcccgtcgttcatagtgataaaaaataagaagattgcaaagcgcatgcaggtttccatgacttttttccaagaccgtaaaaaccgtcgttttggctttctgaacgtccccggcataaaagtatgcgagtgcaagattgttataagccgaccaaaactcagggtaatcggaaataatttcttcaagcatcgcgatcgattcctgaagctgtccattttccagcagtgatttggcccgatcctgtttcaaaatcaggtcgtcctgatcgaactgcgaatagccctgatcttcctctcccatatccaataaatcaagcagctccgcattttcctcgctgaactcgccgtccggatcttcctttaaataagtctccgccgctttataggcctcttgaaaaagaccgaggtgcgcatagttgttcgctttaaaatagtagcattcagtcattttttcgttgatgttcttcaggataaagtccaaaagttcgtttgattgctgataaaagcccatttccgtataaataaccgcaagttgggacagcattcccgtgttttcaggttcaagaaaaatcgctctctgtatgagcttgctcgcgcgggataaatttcgctctctgtatgctttgagccctttatgataaaaatattgcccatcttggaacagctggacaattctcgaatctttatgatgttcagaagtgtactttcccacagataccctccatttcaaactatataccgtgagtagtataacatagtttccagcaggcttaacaggccaaaaacaagtttcgagaaaattctcttcattttccacatatggttttttcaccattttattccggacgtttggagcaccaggccggatagggctttcagaaggatgaaggtactttttatatcggaagtacgcttttcatcttaacccgggcaaaatctttttttagcacttaatgatgacgaatgtacgttcccattgtatgataatagaaagggggttcacgaagtgaaaaaaggcggatcaatagaattgacgcattactcagaagaacattcagctgcgcttctcgaatttgagcttcctgaagaacagcatcgatttaccgctcttccgaaagaggctttaaaacggacggacggccagtttccaatcgtaattttaagcgaaggcgagcctgtcggatttttgatcctccatgcgaccgagagggtaaaagactattcggacaacccggacgccatgctgttaacggcgctatccgtcgacagaaagcaccagggaaaaggttttgcaaaagaaggaatgctcaaacttccagagtttgtctccaaggagttcacccattgtcatgaagtcgtgctggttgtgaacgtgaaaaacaccgcggcccagcacctgtatgttaaagccgggtttgccggcacaggggaaagaaaaacagggccgatcggagagcaaatcgtgatgaaattgaacatcaaatagctcccctaccgggaaaacaaccaaaaggccaaccgccttttggttgtatgcagtgtgcttatgattcagatccttcatggcgctctttcaagacgccaagcacatcatcaagcggaagggactgctccctcagcaaaacgagcagatggtaaagaaggtcagccgcctcccatttcagttcttcaggatcacggttttttgcagcgatgatgacttccgccgcttcttcgccaactttcttcaaaatcttatcaacgccttcacggaacaaatatgttgtatatgcgccttcaggcatttcagcctgccgtttggcaatgacggtttcaagttcattgatgatgtcaaagcggccgccatcagtctgtctgatatgttcgccgggcgagaaacagctgtagcttcctttatgacaggccggccccaccggttcaacaagcacgatgagcgcatcttgatcacagtcaagcctgatgtctttcacacgctgaatgttacccgacatcgctcccttatgccagagctctccgcgcgatctgctgaaaaaccatgtctccttcgtttccagcgttttttcaaacgattctttattcatataagcaagtgtcagcacttctttgctcgctgcatcctggacaatcgccgggatcaagccggcttcattaaatgtcaactcgtctgccttgatcatcttacattcaccccgcgctcttttaaataagcttttacttcttttacagatgtttctttgtaatgaaagatagatgcggcaagagccgcgtccgcccggccttctgcaaacgcatcatacatgtggtccgcacgccctgcgcctccggatgcaatgaccgggactgaaacggcttctgacacaagctttgtcagcctgcagtcaaatccgttcttttctccgtctgaatccatgcttgtcagcaggatttcacctgctccccgctgaacggcttccttcgcccaggaaacggcctcaaggttcgtttttttccgaccgccgtgtgtataaacatagtacagatcagcttctggatcgtattttgcatcaatcgcgacgacaatgcattgagagccgaaaaagtcggcgccttccgttatcagttccggccggagaacggcagccgtattgacggaaactttgtcggctccggcccgcagtatcgttttcatatcatccaaacgattgatgccgccgccgacggtaaacgggatcgccagcttggccgccactctttcaacgacatcaaccatcgtttttctcccctcgtgggaagccgagatatcgagaaaaacaagctcatctgcgccttcatgatcatatacttcagccagttcaaccgggtcgccggcatctttcaattcaacaaattgtacacctttgacaacgcgtccatcttttacgtccaaacacgggatgattcgttttgtgatcactttgccgccaccctttcaagcgcttcagccacggtaaattggttggtataaagagcttttccgacaatagcgccagagacgccttccgaagcgcgggaagcgagcgcctcaagatcggcgagagaactgacgccgccggaggcaatgacttgtttgccggttgccctggcaagctccactgtactgttgatattaggtcctgacagcattccgtcagtcgcaatgtcagtgaagataaaaacttctgcaccttcatttgcaagctcgcggccaagctcttccgctctaacggaagaggtctcaagccacccttcagtcgaaacaaatccgtctcttgcgtcaagaccgattgcgatgtgccctccgtaggccttcagcatttttttgacaaactcggtatttgatacagcagagctgcctaggatcaccctctcaatgccttgcgacaagtagtcatacacgtctttttcggtcctgatgccgccgccgacttgcactttaacgtcaagcttatcagcaatgcttatgacgtggccgccgttcacttttttgccttctcttgcgccgtccaaatcgacaagatgaatccagcttgccccctcttcagcaaaccgtgaggccatctccagaggggaatgaccgtaaatcgtttctttttcgtaatctccctggatgagcctgacgcacttgccgtttcttatgtcaatggcaggatatacagtaaactcgctcattttttcaccttctgttcttgtgtaaactgcttgaaccgctctaagatcaacatgccgaccgtactgctcttttccggatggaactgggccccgtatacattgccaagaccgacgacagcgggtacacacacaccgtattcggcgcttgcaagcaaagcttcctcttcgattccgctgacataatacgaatgaacgaaatacgcgaatccttctttcgcttttggcaaaagcggcgagtcgcggtggactttgagaagattccagcccatgtgaggcacttttaagcgatttcccgcttgatcacagtctttcagtttaacgacttttcctttcaacaggccgagcccttctgacgccccgtgttcttcgctttcttcaaacaaaagctgcatgccgaggcatatgccgagaagaggttttccttcgtttgcggcagcttgaataaatgttttcaggccggtctcggttaaaatctccattgcatcccgaaaagcgccgactcccggaaggatatagctgtccgctctcttcagttcatccggatgctcggacacaaaataaggggcatcaatccgttcaagcgctttagaaacgctgtacaggtttcccattccgtaatctatgacaccgatcatttacagcattcctttcgttgatggaattcccttgacccgcggatcgatcaatgccgcttcatcaagcgcacgtcccagcgctttaaaaatggcctcgatcatatggtgtgtgttcgtaccgtaatgaacgatgacatgcagattcattcgcgcttccagtgcaaacttccacaaaaattcatggacaagctctgtatcaaatgttccgattttcctgcttgggaattcagctctgaactcgaggtgcggcctgttgctcagatcaatcgcaacctgggcgagcgcttcatccatcggcaccatgctcgaaccgtagcgtttgattccttgtttatctccgagcgcttccaaaagcgcctgtccgagacaaattccgatatcttccgtcgtatggtggtcgtctatttcaacatcgcctttcgcttcaattgaaaggtcaaactgcccgtgttttgtaaataaatcaagcatatgtgtcataaacgggacatccgtttgaatatccgcttttccttctccgtcaatatgaaaggataatttaatatcagtttcattggtttttcttgcccgttcggcttttctcatcagtcttcctcccggtttctggattcaattgctcttgcatgtgcttcaagcccttccaatctggcaaaggccgcaattttctcagcattcgcgcggaaagcttccctgctgtaggaaatgatgctggagcgcttttggaagtctgtcacatttagcgggcttgaaaatctggctgtaccgttagtcggcaggacatgattagggcctgcaaaataatcgcccaccggctctgaactgtagcggcccaggaaaatggcgcccgcatgtttgatctgtcccagcagcgcatcgggttgaactgttaaaatttccaaatgttcaggagcgagctcattgatgacggaaactgcttcattcatcgtctctgtaacatagatcaggccatagttgtcaatcgactgccgtgcaatctcttttctcggaagatgttcgagctgtctgtaaacctcttttaaaacggattcggcaagcgtctctgaatcggtgacaagaatgctcgatgccatcgcatcgtgttcagcctgtgaaagtagatctgcggcgatttcccggtagtttgccgtactgtcagcgagtatggcgatttcacttggacccgcgatcatatcgatatcaacctggccgaatacttcccgtttagccaaggcgacgtaaatatttccgggtcccgtaattttatcgacgggggtaatcgtttccgttccgtaagccaatgcggcaatcgcttgggcaccgcccattttgtaaatctctgtgacgccaagctccgcagcagcagccagcactcccgccgacaatttaccgtcttttcccggaggtgaggcaaggacaatgcggtcgacgcctgcaacaagcgccggaatgacattcatcagaacggatgatgggtaagcagccgttccgccgggcacatacacccccgctgaatcaagcggcgtaattttttggccgagcatcgttccgtccttgcggtggtaaaaccaagatgttgcgagctgacgctcatgatattctttaatgttgaaaatcgccgcctgaataatctcgagatcacgttcttcgagcgcgctgtatgcttccttgatttcctcttcggaaacgcgaaagccggccacatccgctccgtcaaattgtcttgtgaatgcggaaacagctgcatttccgttctttttcacttcttcgataatgccgcggactgcttttctttgttcctccgttccggcgtcaatagagcgttttagtgaaaccgacgtatttccgctgatggatttgatcttcattttgctttttccccttccacaataagagaaagtcttgaagccatttcatcgatgactgcgtctttcattcgatagctgacaggatttacgattaagcgggatgtgatgtcgcaaattttttcagtttcaactagcccgttttcacgcaaagtctgccctgttgatacgatatcaacgattcggccggcaagcccgatcagcggagcgagttcaatcgacccgttgagcttgatgatttccacttgttctccctgttctctgaagtagcttgatgctacattcgggtacttggtcgcaacccggggcgcaacggtgtctgccgccgtctcgggcaggccggctacggcaagacggcatttgctgatgtttaaatcaagaacctcatagacatctcgttcttcttctagcaagacatctttgcctgcgattccgacatcggccaccccgtgctcgacatatgttgtgacatccatcggcttagcgaggataaagcgaaggttttcttcaggcacttgaatgatcagctttctcgaatcgtcgaattcttccgggagctgatagcctgcttttcgaagcatatcggccgcttcctcaaatatccgccctttcggcatcgcaatcgtcaattccttacccatgcttctcttcctttctggctccgataaaataggtcacgttttgaaaagactttgtcatttgatcaatatctccgattcccgctaagtcctgcatgacgacttttttgccttttcttcgttcttcttcggcaaatctgattgcctcttttctctgttctgtgctgaagatgacgacatcgatcttttcttgttcttccgccggcttcaatgcttccagcagcctgtcagtcctgatgccgaaaccggttgccggtgcgggtgagtcgaagcggccgagaagctgatcatatctgccgccgtttccgatcggaaagccgacgttttcagcatagatttcaaacaaaacaccggtatagtagctcatatggctgaccatgcctaaatcgagcttaatgtcgtctgtgcaaccataatcgccgagcgtatcccatagcgtttcaagttctaaaaccgcacgttttcctttttcagaatcgacgatggatgccgccctgctgcacgtttcaataccgcccctcagctccaaaagctccagcagcctgcttttatcaattgaggataaattgagggattttacatgctcccgatagccgacatagttcttttcgtataaatagcgccgcaggacatgagccctttcttcattccctaaaacttccacaaacaaggcgtctaaaataccgacatggccgatcgagattttaaatgaagtcaggccggcatttttaagcgaaaaaatgacgagcgcaatcacttctgcgtcagcgcttgtcgatccatcgccgatcagttcaacgccgacttgctcaaattcggcggggcgtcctccttcacgctcctgtgcccggaacacatttgcagcatagcctactctgagcggatgatcgtctttatgaagctttgaggccgccaccctggcgattggagccgtcatatcaggccttaacacgagcgtctgcccctcctgatcaaggagtttaaacaactgctgatccaatatggccgactgcacaccgaccgtatcataaaattcaagggcaggcgtctccatgaactgatacccccacaaagccatcacctctgttaatgaagagcgcacctttttctttgtttcgtaaagcataggcagcgtatcccgcatgccatgcggtttttcaaacataaacatttacacttgcacccccataaccgtttgaaggaaaattccgaatcctttagttcgctaatatgataatatgctaacagataaaagaatcaaaatcaacagccgctcataaaatagacgcctgcaccgtatgggaaatgataacttttatgtaatgaacatcttgatgttataatatatatacgatcgcaaatctttgccttaaccaaaccagcaacgggaagacaggagactcagaatgaaatttttcaaaactcttttttttatttttttcgtagcagttcttatgaccgccgttcttatactgttttctaaagatgcgttaagcccgttagccgaaatgttgcacagcagccataaaactgctgctgacaatgcgaataataaaggagagcgtcagccgcttgacgttccgctgatcaaccaaatggacccgccgaagctttataacggctgtgaagtcgccagcctggcgatgatcttaaactacagcggatatagtgtcacaaaaactgaacttgccaatgaggtgaaaagagtgcctctgcaatatgaaaacggcttaaagggaaatcctaacgacggctttgtcggcgatatggaaaacggacccggactgagtgtctaccatggcccgatttacgatttggcccattcatacgcaggtaataaagcggtcgatctgacgggaagtgagccgggaaaaatttatgaacagctgaatcagggcagaccggtttgggtcatcaccactgtacatttcaccccagtcaacgatatggaaacatggaatacaccgtcaggcaaagtcgatgtgacgtacagcgttcacagtgttgccgtgacaggctatgatgagtattacgtttatgtgaatgatccgtacggatataaaaacagaaaaacagacagagaaaattttgaaaaatcatggaaacagatgggcagtcaggcgatcgtgatcgccgcctaaaaaggcagattaatccctgcctttttttagttctttcagcccttattaaattaagccgctttacccttttgataaatccaaaatacagaaaacaacctttctgcacatgtttaatttactgttttttcataatattcaaaatacttgtttacattcagcaagctcgcatatatgatagtaccgaaataggtgtctcattttattacataatgaccagaaatcactttcatttaagggagacacacacctgtttcaaaaatatttcttgaggaggatggaaatgatgaagagattagcaggtacggttattttgtcaggtttgctcgtatgcgggtttggacaggctctgcctgaaaaagctttggccgccgaggtcgttcacaaaacgatcgtagtcgagaaaggccaaacgtatgacggaaaaggcaagcggctgattgcaggtccggagctcggggacggcagccaacgcgaggatcaaaaaccgattttcaaagtggaggatggtgcaacgctcaaaaatgtcgtgcttggcgctcctgctgctgatggtgttcacacatatggaaacgcttccataaacaacgttgtttgggaagatgtcggcgaagatgccttgactgtcaaaagcgaaggaagtgtcacgataaacggaggatcggcccggcttgccgcggacaaaatctttcagattaataaagcgagcacatttaccgtgaaaaattttactgccgatcaaggaggcaaattcattcgccagctcggaggctcgacatttaaagccgtggtcaatattgataactgtacgattacaaacatgaaagaggcgatcttccgaaccgacagcagtacaagttccgttacaatgataaatacaagatactcaaaagtcggtcagaaatggatcggtgtgaagcatgttacggaaagaaacaatcatgaattttaacactgattgcaaataaaggcccccgctctttattcagcgggggtctccaatcttttttccatttcttcttttgtatagatcagccgcatcggattgccgccgacaaaagcgcccggaggcacatctttatgaacgagcgtaccggcggaaatgacggcgccgtctccgatctcgacgcccgggaggatcgtcgtattggctccgatcatgacttcatcgccgatgatcacctcaccgagccgatattcttttattaaatactcgtgcgccaaaatggtcgtattatagccgattacggtgtttcgcccgactgagattttttcgggaaacatgatatccggcatgaccattaaagcaaacgagcatttctctccgattttcatccgcaaaaacgtccggtacatccagtttttcattccaagaaacggcgtatagcgcgccgcctgaatgacaataaagtttttgactactttaaaaaacggaaccgtctgatagatgtgccataaggaattggcgccggacaccgggtagcgcttcgtttttctcaaactttctccaccccaagaatgtgaaggaggtcgctcatttgctgaagcataaaatcaggctcgtgtttggccaggctttcttctcccttaatcgtccatgcaacgcctgctgttttcgttccagcattcttcccggctaaaatatcgtggtaattatcaccgatcataatggcttcttccggacggctgccaagcttggaaagggcgagcaaaacaggctcggggtcaggcttcggccgctcgacgtcatccagcgtcacaaccgtctcgaaaaaggcatcaagcccagtcagtttaagccccatgatgacggtgtcccgcagctttgtcgtgacgatgccgagcttatagccttcttccgcaaggcgttcaagcgtctcgtaaaccgtctcatactcggttaccagttcatcatgcatctgatgattaaatgtccggtacatggtgatcatttcttcagccttatccttttgaatgcttgagaacgtttcataaagggaaggtccgatgaaagcaagaacatcctcccgtttatagcgtcccggtgcataatgatcgagcgtatgcaaaaatgaggcgataatcagctcatttgtattgatgagcgttccatccaaatcaaataaaaccgtattaactttcatacaaagcttcctttctgcgaacggaataacccggctttctccagaagcgcgaaatcgcgatcgtcagcagaaccgcggtcgcaagcctgatcaacaaaagaggccagaccggaatgccgagcgggataaataccaatgtatcttcaacaaccgcgtggcaggcgacgagaaaaataaaagcaagcgtgacatcccttttgctgacgccgtcttcttcgaccgctttgatcataacgccggccccgtatgcaaggccgatcgtcagcccggcaaccattgtcattgaggtgttctctttcattccaagcattctcgttatcggtgcaaaccactttgaaaaagcattcagccagccgaggtctctcatatattgaatgatgatcatcagcggtattacgatggctgcaagctgaaggacaccaagacccgccttggtcacggcttctagcgcaatgtcaaaccagccggaaggagcggcgcttttcgctgagattaagccgtatttggccgcatcctgcccgccatgccagacaaggttgatgataatggccgaaaaaacagcgagaccgatgcgcacgagcaaaatcagccatattttgattccgacccttgaagcaacagtcgactcgataatcaagttgtggcaaaacgacagcataaccgctaaaataaacacttctttaacggtcaaatcaagcgttaaaattcccgcaattccggcatacaagttcagcatgttgccgagcacaagcggtatcgccgcttcccctgacaacccgaaaatccccatcgccggcgtgatcagtttgatcaaccagtccatcaccggtgtatgctgaagaaggctgacaatcagcgtgacaggaaaaatcacttttccaagcgtccacgttgttttcagccccgccacagcgccggcttttaaagttcccttcattgttgtcctccccttagtaaagtcgctacatctcctgataccgtttaatctctctgcctttgaaacgtctgtaggctatcagcgcagctgcacagaggatcagtacgatcgaaataacctgtgcgatgcgaagattctccgtcagcatcagactgtccgttctaaggccttcgataaagtagcgtcccatcgaataccaaataacgtagattaagaacagttcgcctctctttaaattcgcttttcttaaaagaagcagaacaacgactcccgtaaagctccacagcgattcatacaaaaaggtaggctggtagtattgtccgtcaatatacatttgattgatgataaaatcaggcaggtggaggttttctaaaaacgctcttgagaccgcctcaccgtgcgcttcctggttcataaagtttccccagcgtccgatcgcctgaccaagcagaatgcttggagcagcgatatcagccagcttccaaaacgaaagccccttgactttcgcataaatgattcccgtcagcacggcgccgatcagtccgccatgaatcgcaaggccgccgttccatatttgaataatctggtcaggatgttcactgtaataaccccattgaaaaatgacataatatgctcttgcacataaaatggcaatcggaatcgcaaaaagcaccaaatcgacaaaggtgtctttatgcagtcccctccgttcgccttccctgactgccagccacaaaccgagcaaagcgccaaggccgatgataataccgtaccaatggacagcgatcggccccagttgaaaagcaatcggatttaatggttcaatcgtttcattcatattgtcagctcctattcttcaagctcaccatcttcaattacatccgcaagcttatgggtaaattgctccgcggcattcagccccattctcttcagtctgaagttcattgcggccacttcgatgatgacggcaaggtttcttcccggacgaaccggaattgtcagctttggaacgtctgtatcaataattttcattgtttcttcttcaagccctaagcggtcgtactgctttccttgctcccaaagctccaagctcatgacaagggtaattcgtttaaagcttctgaccgcccccgcgccaaataacgtcatgacattgataatgccaagacctctgatttccaggagatgctcaattaattcaggcgcgcttccgatcaatgtatcctggtcttcctgtctgatctcaacgcagtcatccgccacaaggcgatggcctcttttgacaagctccaaagccgtttcgctttttccaacgccgctctttccgataatgagcaccccgacgccgtaaacgtcgacgaggacgccgtgaatcgcagttgtcggagccagctggctttcaagaaaattcgtcagacggctcgtcaggcgcgtcgtctttaatggggaacgaagcacaggcacgccgttttcttcggatgcctccacgagttcaggcggaatcggcaaatcacgggaaaggatgatagccggtgtaatttccgtgcataacgacagcatccgctgctttttttcctcctctggaagcttttcaaaaaaggtaatctcagtcttccccagcagctgaaccctctcttttggatagtatgtaaaataaccagccatttcaaggcccggtcttgataaatcgctcatcgtaatcgggcggttgatcccttcttctccgctgatgagctcaagcttaaatttatccatcacatcttttgttcgaactttcggcacgattgatgcaccctcctcttctcagatgaagaactagacattcagctttattctatcactttcaaaatgaacctaaaacattttttgataatggcccccttgacacttcgatgaagtgctttctttcaaagcgaaaaatcagtagtatgtaaagaggaacgcgaaaaggaagtgaagaaccgttgaaatacaatattcatgatacaaccgtgctgaacgaagacattttgacaccggaagaaaaagagacatgggttctttatatgaaagtactgactgctgccggcttgggggatgtctccgaatggatgaagctcgatctcagcatgccgcaaatgaaggttttaatgcttctgaacaaccacggcacactgaaagtctcagaaatcgccgaaaaaatgggagcttccctttcgaatatgaccggactgctcagccgccttgaacaggcgaactttatcaaaagaacacattccgagcaagaccggcgaacgattgtggttgaattaaccgaagatgcgaaggggatttttcggagcctttacaaaaaagggcatgaaaagctcaaaagagcgcttcagaagctgaatgaacaggaaaaaaacaaagtgaatgaaggccttacaattcttgaaaaagcgttaaaagccgatgatgaatagacaagctgcccggaaaccggtgcagctttttttgttgaaaaatttcttttgacaaaacgtgcttttttaaggatgataaaaataattcattcaaagtgaattattcattcgaagttaatgaaaaaggaggatacgtggcgtgaaccaaaagtgggctgtattattgtttacgatcggcgtgtttatggctgctttagacaacggcatcatttcagcggcactgacgacaatcaatgattcttttcaagtatccccctcatggggagcatggggcatcacgctttatacgctcggtttggcagtcagcgttccgatcgtcggaaagctgtctgaccggtatggacgcaaaaagctgtttatcatcgaagtcttgctgtttggcgccggttcgctgctcgttgcattgagccaaaacttcccgatgttcttgttggcgaggctgattcaatcgcttggcggaggcggaatctttattatcgggagctcgcatattctcactgcgctgcctaaagaaaaacagggaaccgccttggggcttttaggtgcgatgaacggaatcgcggcagtgctcggtccgaatatcggcagctttattttggatatgaccggaagctggcactggctgtttttgatcaaccttccgattgccgcagcactgatcatcctcagcgttccattgatgaaggagacaaaaggcggaacacgaaaacccctagatctggccggaactgtgatattgtctcttgcgattttagctgtgatgtacggaataacgaatataaacggacagcgcctgtctgccgtcttgtccgatccaaaggtttacttttttctcctgatcggctgcgcgctgtttgcgggactcattttttacgaaaagcgcgtagagctgaagggaggcgacccgatccttgcctacagtttattaaaaaacaaggtgtttcaatggacgctttttatcggatttttatccggcggactcttggcagccgttatttttattcctgcatatgcggaacaatatttgcacgtcgctcctgaaaaagcggggtattggatgacgcctcttgcgctggcttcagggataggagccgggctcggcggaatgctcgccgatcgaaaaggaccggtaaaggcggcccggctctctggcgtcatttcgttcgccgggtttttgctcttgtcctcctgggtgacagagaagtgggaatttgttttggcaagcatcatcgcaggggtcggttttggctttctgttaggcgcgccgttaaatatgcttgtatccgaggcggcaaaacaggattacgggacagcgctcggtacattatcgctcgtcaggcagatggggatgaccttggcgcccgcgctgtatgcaggatatataacggccggctacgaaaatatcggcacacatatcaaacataagctgaatgatgcagggatcactctgaaggggtttgcaggcggtgagacggacgtatcgcggctgagcgaatccctcagccaaattcccgacccaaaagtaaaagacatcataagcgaagcgatccatgaaagtgtgggagcggggttttttaacctctacttcacagccgccgtcctttcacttgcagtcattgcttctgtcagcgttttatcgctttataggaaaaaacaaaccgacacggcaagccgtctaaaaaaagacgtgacaaactaaaaagcatttgctccctcttaggaaaacaaatgctttttgcgttcgcaaaggaaaaccgccgccagccacaagctgatttcagcaattgggaggtttgtccctttctttaaaatcatcccggccggcggggggctccccgacaattgcctcagggccgagcccgccccggctgtttgatctattaaaaaggatttcatgccatcgtcttttgtcgtcaatctccacatttgagacctgctgttgccgccgtattgatctgaagctgcggcgtaccagaaataggttgtattcggctgcaaatctttccacgtcacggaagccgtctttccgcttttcaccgtttttgctttcccaatttccttgttcgaaaagacattcagctcaaaataatcagttttaacctttttcttcctcggtttcagatccgttttaatgttgaactcgtccttcgggccaaattggtgcggatcataaaagttatagtcatcaagatatggcgaatacgttttgacatggatcgtgtcatgcttcggatccacatggagaattcttaaataaccttggcctccttcaggaccgccctgatagtcggcaagcatttgataaaccttgcgatccggcttgccgtccccgttatcatcaagcttgtcgacttttaagttggagctgtgatagtgaccgctcaatacggcaatcacattcggattccgcttgatgatctgttcaaatattttctccccgattggacttctgcttccgctgacaagcaaaaactcgtgaaatgccaaaatcgcttttcgatcgggatggcgtttcagaacatcatctatccactgcagttctttttttccgattccccaccccatcgacaccatgatatagtcgttgcccccgctggaaatgaggtcgtaatgccctttgttattctgataagacccgccgtaatgcggtttttgtttaaaacgcctctccccgaagtacctgccgaatttcaaatatgaccggtctttatggctgacatcgtgattgcccgccagcacgccgtatggaacttgattgtcgtcgagaactttcatgaactggtcggcgcgcttccattgcagcggctgatccgcttcatccacaagatcccccgtatgaaagacgtactgaatgttcagcttgtccttttgttccgcgatccacttgacctgacgttcaaaaatgtgcggatagctttccgaataatattgcgtatcagacatccacacaaatgtatagtcattttgcgaaagctgaatttgatcctgaatgatgatgctcgccttggattggcggatataatcggcggcttttatgcttcctttgagggtaaaaggtttgccatcctttgcaacatggaatgcaagcgtctcccacctcttgctggcccagttccaggcgaacatggagacttttctgccgggaagcgaactcccgcgccacagcacttccaccttgtcgttcggccccgtattttcatccacttttacatcaaagcgatggtacggaaactttgttgttgatgaggtttcaaaaccttttccgtcaagtgcggacatgccgctgcgctcttcttttgtcagcgccttttcccccctgaccgcaaagctttgcggaggttccgtcccgctttcgttcgctgacacatcaacatgctcttcgtcttttactgtgtactgaaatccctgatggaatgacactttcatcttatcttttgtcgggtccttgacgcggacggcgagcttagcatgtgtgctgccgggtgtatttttgacccgagcgggcttgtccggcttttcctctttaatgtaaaatgccttttttacgattgacaggttgccggcgctgtcctccgcttttattttcaactcgtgctttcccgcatccaggcgggcagaagatacgagatagggaagcgcaatctttttgccgtcaagaaaggcttttatgcttttcatcccgctccatttatcgtgtgcggccgcattgatctcaaacgaccctttatacgtcctgccgtcttttaatgacgttttgatctcaggacctgtgttatcgaccgttaccctgcggatgagcctttcttcgccattctccgcttcaacgatgtgctgcccttcgttccaggcgcgtgtatgccattgactcgcaagcgatgcaaacttggcttccggaatcgtaaaacggaattcataccattcatgcgccccagggccgtcaccggccggaagctcggctttcggatcgtcgtatcgctcatcgcggatgatggtcccatccgcgagtatgaggcgggggttcttgaggacaaaatcatccctgttttcttctgcagtttgttcaaatggtgttgatttcgtacctgaacgaactttaatcgaaaacggctttccttttttaaattcatccggagaaaccgggaccgtaattgtcgcataccggcggcgcgaatcgtcaaaaactttttgaactctcctgccgatcgttacagcatttttaaaatacagattcgtttgattgacatcgaaagcaaagtaggcttttttttcaagcgccggttcaccttctttttgttcaatcccgtcaatacgaattgtcgtttcagaaggcggcttttctgatgtggctttcaacagcatttttccggaaacggttccgccttcgcttacattcagcctgagtcccttcaaaatgcgctgttcgagcggtatcgttttcttttcagtcgacgaaacatttgatccatcaccggcccgcatatagtactccactttttctttgccaatgagttcggcaaaatagatattgtggcggtacaggccgtcattgcggcttttttcaacacggacttcggtaaacggctcatcatcattcatgcggtagaaaaactgcgcctgcttcacttgccgattgtctttcatatcagctaagagctggatcgtttcacccggttttacagcttgatgatccgtcatatcatggatctccggcttttctctgtccggcataaccgtcaccgtctgtgaaggtgcctgcgtcttcagaagcgaaccaggcgacggtttttcttccccggccgatatgattttcatatgcttcgttccgtccagcggatatcgatacagaagcgctttatttttggcgacatcggttttatccggctcgctttgataacgggcggatgcgacctcttctccgctgtttgtgcagatgatcacctctctcggcgccgtattctccatgccgccccctttgagagcagtaagcgttttgccttcacgaaggtgaacaccgtaataccgattgaaatcactttccgtcagatgaccgtttgagcggtttttcacccaaaacacgtgtgtttgaccggaaggaatcgccacatcatcgtgctcaaaaggccagatgacgtctgattccttgcccttttcaggatgtctgtacttgattttgtagctgttcagatgaacagctttattggtattgttataaacttcaataaattcatagccgtcctttccaccggtgtttgacgtgtcgactaccatttccgtgatcaacagctccggaagcttttgtgtatctgtacgcatgcctttcagggcgacagtatacacatccgtcttcacagaggagtcgccgacttgagcttcaatgtagtactggactttgccggatgctatggattcgctttccaatttggcaatataggcgttctgtctgcccggctcaacttccatcggaatcgcccgatacggcaattcgtcatgctgcttgtaatataaaatgaccgtgtcggcggccgcctgcgcggaaaaatatatgtcatctcctttttgaacttgttcaacaggagtatgcctgataaccggtgaaccaggctgaatatgctcttcacccgatgcggacgaaatcgggatctgcaaggcaaaaagtaaaactgcggccaacaataaaagggtttggcgatttctgtactttttcatcgtctacctccctttcgtattttgcctttacagatcatttttatgaaagagacatccgggcaaaaaaaagaagcctgatgattcatcagacttcaacttattttctggacatcggttcgataattgctttttgaatgagcaagtgaaaaaccgacaggacgatcgacgcaaaaatggctgtcccaaagccgtccaggtcaaaactgtcccccataatggacgcggtcatataaagagtgatcgcattgatgataaacaaaaataaacctagcgtaattactgtgacgggcagcgtcaaaatcaccagcacgggcttcacaaacatatttaagatggataaaatcaagcttgccgtaatggctgctccgatgcttctgacgtgaaccgcatcaaagtaaccggcaatgacaattaataataaggcattgacaagaacgtttataatccatctcatcatctgttgacgtctccttcattcggcacaaggaatacccagacaatataaatcagcaggacgggaactccggtcgaaaatataaataatagaaccgtaatgattctcagcaatgacgcatccatatttaaatattcagcaagacctccgacgaccccggcaatctttctgtctgtttcggatcgaaatagccttttcattgtatcactcctgtgtatggtttaaatggatcgatcctgtcttcgattccaaaaacacggtcatgctatgatcatgattttgatttgcttttaggtacatttccttctggattgtctcgtttttttcctttaaaatttctgcatctgaaagatcatgagacagagaaccgagattgcttttcagctccgctgtaacagcgcagtcccggggaacattcaactctacgcttccagtcgttgttttcacatatgccgtccggcagtgcggatttttgactgttgccgcgatattgccgttaaagctctgcaggtcaagcgcctcgcatgaacctttaaggtcgatcaatccattgatggtttccgcttcaatctctccgcaagtatggtcggctagtttgatttgtccatttgcagtttccaatgaagcttttcctgccgtgagagcagagaacgacagcacgccgttcgtcgttttggcggacagctcttttacgtttaaatgttcccctctgaccgggccgttaaacagtttaaagcggattttgccgtactctttgtccggtatatagacggtaaggttggtcttcatcgtttttttctcggtacggatcatgaacttatcgccttccacaccgcagtcgatatgctggagaaaagcctgccttgcttcatcctgattttcagcccggtacacttttgcctggcattcgactctgatgtcggaatcgctccatggtacaaggttgacgctgccgttggcaagctgaatatccagagtcgaaaaatcagtgtctttaaactggaatatatgctggacatcgtacgagtgcccgaaattcaaatccaagtctgcttcttttactttttttacagcggtatcaatccattcgaacagttttgaaccgatcgaaggcttcggttcttttttcttttcgctgtagaagtcctccgaatcaatgacatcctcagacagggctgtcaccttgctctcggtttccttgtagtcttcttcaagtttttcgatcaggatcagcgcctcttttgcagacagctttccttcctcgaccaattttaaaattcgttctttctcatgcttcatgaaaagctcccccgttctccttcttttaggcctgagtcagcattttaatcccttgaactacgttccagaccacaataatcaaactgatgatcccgaaaaaaacgaaacctccgatcatgaaaatgaccgccaaataaccgccgtcaccaaagataagcgtaccgcttatcgcgcctgctgccaatatgactacgcttataaacggaataatatgcgaaataagcgaacgcatcgcatgctttttcgtttcttgatcatctgttataaaatacgctgcgattggcaaaataagcggggcaaaaaaaacactaaaataacaaattgaagaaatcagcgcgttgtttctcgtcatacataacactccttatgatgtaaaccgttctttgtgagtctaatgtacagtgaccttatacttagtttacgtgtatcatggcctttaggtttcattttcattcgatcggcgtgcgtcaaacttcgcaaattgatttttttagattttatgaatagattctttttttataaccctttaaaatatgtggcaaagccaatgaaaaggagcgagcgttatgaaacagaaatcggaagtatacgcctcatccgcctcccagcttcttagtctgattcaggaacaaaaaaggatgaatcaggagatcgtgaaccgattggaatcgatcaattccgctcctccgctttccagcgaaatccgctatttaaaggttctgctgaacagcagcagcacccatattttaaacagtatgagtgaagcgaccaaacacatcagccggactgaacgttaaccgttttcatgatattttaaccagatttccgtcgggatctctgatataaaccgaaacgaccggcccttcagcgcccattcgctctgcggggccttcttcaattttaatggacagcccctccagatgacgaatcacatcatcaatgccggcatttgtatgaaacacaggtctgcggagccgggcatcgggtgctgtgccttcggctcaaactattttccggcttcgtggaggtttattttttgcctgccgaatgtcgcgcttttcttccttctcgaaaagtgaccgcattcaaccccggcacacggctgtaaaaatcacatgtcgcatcaatgtcttttacagtcagtaccaaatgatccatgcgatcgatcttcatcaccccatccccctttattgtttgtttttttacgttataacagctattgaataaaagagcaatgaaaatctttttgaacaaagcttgccgcggatcattcggccattgaaaaagctgccgacgtgacatcggcagctttttctttacggtctgacagcttctttttcttgaagccgcttcttcattctgtttttgtcgcgttcaatgatcggttttaaataacggccggtatatgacccttcgactttcacgacttcttcgggaggtccggcagccacgatcattcccccgccgtctccgccttcaggacccaagtcgatcaaataatcagccgcttttataatatctagattgtgttcgattacaagcactgtatctccattgtcgaccaggcgctgcagaacggccaaaagccttgcgatatcatcgacgtgcagtcctgtcgtcggctcgtccaaaatataaagggatcttcccgttgaacggcggtgaagttcagatgccaatttgacccgctgcgcttctcccccggaaagcgttgtagccggctgtccgagcgtaatatagccaagaccgacatcatagagggtctgcagcttgcgcttgattttcgggatgttctcaaaaaattgaacggcattctcgaccgtcatctcaagcacgtcagagatatttttgcctttgtacgtaacctgaagcgtttcacggttgtatctctttccgtggcaaacctcacaaggaacgtatacatcgggcaggaagtgcatctcgattttaatgattccgtcgcctttgcaggcctcacagcgtccgcctttgacgttaaagctgaagcgccctttcttgtatcctctgactttcgcttcattcgtctgggcaaacacgtcgcggatgtcatcgaacacgccggtatatgtggccggatttgacctcggcgtccggccgatcggagactggtcaatatcgatcactttatcgaggtgctcgattccttttatttctttgtattctcccggtttcgtcttagcccgatgcagcttctgagccagcgttttgtggagaatttcattaacgagcgtgcttttccctgatcccgataccccggtaacagctgtgaacacgccgagcggaaatttcacggaaacatttttcaagttgttttcctttgccccttttacctcgataaagcggttgtcaggctttcttctctcggcaggaagaggaatgaattttttccctgaaagatattgccctgtcagagattgatcatcgttcatcacttcttccggcgttccggcggagattacttctcccccgtgtacacccgcgccgggcccgatatcgattaaataatcggcggcaagcattgtatcctcgtcatgctcgacgacgatcaatgtgtttccgatatccctcatgtttttgagcgtctcaatcaggcggtcgttatcgcgttgatgaagaccgattgacggctcatcaaggatgtaaaggacaccggtcagccttgagccgatttgcgttgcaagcctgatccgctgcgcttctccccccgacagagtgccggctgcgcggctgagcgtcaaatagtcaagcccgacattgttcaagaatccgagcctttcttcaatctcccgcaaaatgaggttggcgatcttcatgtctttttccgaaagatcaagttcacggaaaaattgaagggcgttagctaccgacatttcggttatcttaccgatgtgaaggccgttaatcagcacggcgagggattcctttttcagacggtagcctttgcatgaagggcacggctgattagccatatatttttccatcagttcacgaacataatccgagctggtttctttatagcgcctttcgatattgcggatgacgccttcgaactcaatgtagttttcccggacttgtccgaagtcgttttcatatctgaaataaatctgctcgcctccgctgccgtagaggattttctcaaggtggtgcttcggcaggtctctgaccggaatatccatatcgattccatagtggctgcataccgcttcaagcagcttcggataatattgggagctctgcggttcccaaggtgcaatcgcattctcctttagagacagctcatcgtttggaatgacgagctctacatcgacttccagcttggacccgaggccgtcgcagctcggacatgcgccgaacgggctgttgaaagaaaacatcctcggctccagttccccaattgaaaaaccgcagtgcggacaggcatggtgctcgctgaacagcagctcttcctgcccgatcacgtcgatgatcacacggccttcgccgaggcggagcgccgtttcgagcgagtctgtgagacgggcggttacgccttcttttatgacgatgcggtcgacgacgacttcgatcgaatgctttttattcttttcgagctcgatgtcctctgagaggtcgttcatttcgccgtcgatccggactctcacatagccttgttttctgatttgttcgagcactttcacgtgcgatccttttcttcccgagacgatcggcgcaagcacctggatcttcgtccgctcgggataatccaaaattctgtccgtcatctgttcgatcgtttgcgaggtaatttcaatgccgtgaacagggcaaaccggctttccgattctggcaaacagcagccggagataatcgtagatttccgtcaccgttccgactgtcgaccgggggttccggctcgttgttttctgatcgatgctgatcgccggcgacaggccttcaatcgcatcgacgtcgggtttgtccatctgtcctaaaaactggcgggcatatgcggagagagactcgacatagcgccgctgcccctctgcatatatcgtatcgaacgcaagggatgatttccctgatcccgaaagacctgtcaaaacgacaagctgatccctcggaatagagacatcgatatttttcaggttatgggcccttgcacctttcacctcaattcgtttcgttgccattttctattcatccttccgattttaactctaggagcaagtcgcgaagctcggcggcgcgttcaaagtcaagcgcttttgccgcttccttcatgtcgctttccatttgagcgatcactttttcccgctctttcttcgtcatcttcgaaagcttcggctcctctttcacttgatattcttcctggtcttcagcagcatgagttgcccggatgacgtccctgatctttttgttgatcgttttcggcgtaatgccgtgtttctcattataagcctcctgctgttcgcggcggcgcttcgtttcattgattgcgatttccatcgagttggtgattttgtcggcatacatgattacgcggccttcggcatttctggcggcgcggccgatcgtttggatgagcgagcgttcggaccgcaaaaagccttctttgtctgcgtcaagaatggcgacgagtgaaacctcaggaatatcgagtccttccctcagcaggttgatgccgacgagaacgtcatgcttgccgaggcgaaggtcgcgtatgatctcgatccgctccagcgttttaatctctgaatgcaggtacgtgaccttgataccgatttccttcagataatccgtcaaatcctcggacatttttttcgtcagcgtcgtgacgaggacgcgttcattccgctcgattctctgctggatttcaccgatcagatcatcgatctgcccttcaatcggccttacctcaataatcggatcgagcagccctgtcggccggatgatctgctctaccatttcaggcgtatgctcaagttcataaggccccggcgtagccgacacatacacgatgttgtgaatgtgcttttcaaactcttcaaacctgagcggacggttatccaaagcggaaggcagcctgaatccatgatcgacgagaacctgttttctcgcctggtctccgttgtacattcctctgatctgcggtatggtgacatgcgactcatctatgaccatcaggaaatcatccggaaagtaatcgagcagcgtatatggagtcgaacctgccggacgaagcgtcaaatgtcttgaatagttttcgatgcccgagcaaaagcccatttcgcgcatcatttccaaatcgtatctcgtccgctgttccagacgctgcgcttcaaggagcttgccttcttcacgaagcgctttgaggcgctcttccagctcctcttcaatgtttatgatcgctttcttcatcttttcttcccgggtgacgaagtgggaagccgggaagatcgcgacgtgttccctctcccctaaaatttcgccagtcagggcatccacttccctgatccgttcgatttcgtccccgaaaaattcaactcggacgcagtgctcatcccttgaagccggaaagatctcgacgacatcgccgcgcaccctgaatgttccgcgctgaaaatcgatgtcattccgcgcatattggatgtcaacgagctttctgagcagctcattccgctcgatttccatttccgttctgagcgagagcaccatttccctgtattcctcaggagaacccaagccgtaaatacaagagacactcgccacaatgatgacatctttgcgttcaaaaagagcagacgtggcagagtgccttaatttatcaatctcatcgttaatgctggcatctttttcgataaatgtatcagtctggggcacgtaggcctcaggctggtaatagtcataatagctgacaaaatattcgactgcgttgttggggaaaaattctttaaactcgctgtaaagctgcccggctaacgttttgttgtgggcgatgacgagagtcggtttgttgacctctttaatcacgttcgacatcgtaaacgtctttccagtaccggttgcccccaaaagcgtctgatgctttctgccttcattgattcctttgacaagctgatcaatcgctttcggctgatccccctggggctgataattcgagactaattcaaagcggtctttcacataaaagcctccgtttctttacgaaatcttcctgtttattattttaacacacccgaagcaaaaatacgaactaaagttcggtttttgtgttttcccacaaaagccggcgatttctgatctatcaaaaaacccctcctttttgtcatcaaaagcagggcttcacggcaatcaatcttacggtttctatgagtcttccttcttttcgcccgccttttttgccgcatagagcgaaccggcgacgagcgaggcgatatcaagtcctacaataaaaaaggtttccgtataaccttttaaatatgaagcgaacaacagcgctgcagtgagcgcaattccgacgtaatggttataggtcacccttgtaaaaaacaagacaagaataaaaggaaatatcagtgcaaaaacggcttttgtaaacacaaaaaccctcctcacgtttcttgatcttattcgattatattaaagaacaaagaaacggacaaacatggacactcattcattttgtccatcatcttgccgcgttattcggaatcggacgttaaaaggcgaaaaagaacgatattccggcggccaggaggtttggcatggcgaaaatggcgagcgcgtttgccagcttgctgttccactccccgtgctctttcgtttctgcatcgtgatttcccctgaaccggtcaccgctgacaaatacgcccgaacataaagcagacaacagaatcgcgcctaggccggctgctcccgaaactttgaaaatcagcgtccaatccccggccgcagccgaaaccaatacagctattaaacaaacgaaagcacctgcgagaaaagcccttttcatcaatcattctccttcaatgagttctatccatcatcctagcggaacgttttgtaaaagacaaccaaaaagtttcgaaacaaggcaaaagcaaaagcgcctgaaagcggcgcttttttaacatcggttattctgtttctgctgaggctgctgcctcggcatgcttcatcaccgcatcctcttcttttacaaagatgatgccgagctcatgatgctccccttcataagaagctctttgttcaaaacgaatctcattgtttaaaccgacgacttcaagcttgaagaaagccctgttcttttggagcgcttcgtagaagtccgccgcatttttcacttcaatcccgttgaccttcgtgatgatttcgccgatcttgagaccgagatcggctgccggcgtgttcggaataatcccgagcaccatcaagccctggtctctctttgaaaaatggaaaggggcggaattgtcgttcatccgctgcttccaggataaaaaggcccttcctgcgatcgctgctccggcggcaagggcggcaagcggagtccaccatatgcttccggccgcgatcagcagaatgatgatgccaagcacgctgatgcgcttcgctgtaattttaatgctttcaatcggaagcgatccttgaaccctttggccgaagccgatgaaatacggaatccacaagagctcaaagccgccgttaaatgacaaaacaggccaccacggaacagatgattcgatcgcatgtcccggaataagaataaacaacggcagaagccaggttctgcccgcaatctgctgtccgatcgggagaccccttgtgctcatgacaatcgcaggggacgttttgatatgtgccgttttatagacaagcactccttccgccaccaacagaagtccgagcaagacggcagcagccgaccaattcgcgagggacagctgcggcagaaacgcgtcaagcgctccgaaaccggtgtattcaatacataaaccaacgacgatgctcacgccaagcgtatatgccgctgacagcagactctgtctgaaagttaaagctgcggcaacgctgaccgccgctattaaaaccagcatgcccatcgggagatacagccccaagccgaacgaaacaatggacagtacaagtcctgccagaagtcccttggaatatgtaaatttgaactcgtcataaatatcttcaatacgcgtatggaacgtctttctttcacgtttgatccgggcatagccgtaagcaagactcataatcatcataaaatagaagagcgggtgcaaaaagaacaatcctgctccttttaaaagttcaattaagctttcttcaactgacaagggaacgttcaccgcctcagccaagcatttcaggccgccttcaacacggcagctttttaacgttggatattttaaggaaacccagcttgtctaaagcgtcggcacgaggaaatgacgggcggccgttcaggcgggatgcctgagccgtcagccgcagaaactttcgtcatgatgcttaaacgccggtgcttttcatgcgcattcgtgacgacaaatgctggcacctttaggcaagctggtgcattttattattattctaacaaataataaaatgcttgggtatggtaaacgtgaggtttatttctcctggctcatccaaagcgtcacattcgacaaagaaaaatctttcaggtaatgattgacctcgacatcaagaatatctcctatcagctgcattgaccgcttgatgtcggtcagattgatgccgagccgcttgtggttgtccatcaagtagttgaaataaagttccgcgcaatcctcattaatatcttccacactttcgaccgaagtgtagttcacgaggtatctgctgaacagcataagcaatcctactgcctttgtagcggaaaacgtaacgtcttgtgatcgaacttttaactgctccactaattcatagtattttttctctctcacaatacttgcccttttcaatcgtgtacccccatttattatttatatataagaaaagcgcaagcgtcagacgactccaccaacagagacgaagaacgcaaacagcgctaacattctccgcaataaaaatgcacacattataattcttgaaaaagctttggttctattttaaaaagttttcctatgttatacaacttgcaaaagttacatttttactgcatctttacatccttataaagtctcccatatacttatgttatcgggtcaattctattcattatgaatgttttttttatgaaaaagcaaaaattttaggtaaaaagattgagaatttactttctgagaataaaaaaagtgaggacatcccgtgccctcactttttgttaaacagcacttttaatgcggcttgcagctgaagatcgttcttttcatccatctttttctcctcaatccgcaggttcattgtatttgccgttttttggtcaatgatccctgtttgcttcagcttgtttgctgcctgaaacgccatgacggctttttttgtgctttcattgtaatagccgtcttcccggccggggacaaacccgagtcctttcagcaggaactgcgcccgcttaatttcattgttgttcatatccggcttgaggggttctttcagctgtaaaggccccgccgagaaatatgcaggctgcgtgactggaacggtcggctgaatgccctgcttatggatccaatttcctttaggtgtcagccatttgtacagcgtcagcttaatattgctaccgtctcccatcggcaccgcctgctggacggttccctttccaaaggaaggatcgccaaccacgtcgtagccctcggcttcttttaatgcgcctgcaagaatttccgaagccgaagcgctgcccttgtccgtgatcacgctcacagggtatggttttttctcttttaattttgagaagtattgttttttatttccgtttctttcggcgatttgtatatacggatgatcttttgtcacaaaatgttttaaaatgtcttccacgctttgcaagtacccgcccggatttcctcttacatccaaaacgagcccttttattccctttttctcaagctttttcagttcagcagtaaaatcttttgccgtatgttcggaaaaggaagatattgcgatatagccgacaggtttatcctgtactttctttatggaagcaaacaccgtttccagcgggatttcatcgcgcttaatcgtaaatgtcagctggtctttcattccgggtcggtgaactttcagtgtaaccgtcgatccctttttgcctctgatctttaatacggcgtcattcaaatccattccgctcatggaatcgccgtcgatgctgatgatttcatcgttcggctttaatccggctttctctgccggagactgtttaaaaggagaaacgataatgatttttctgtcttccattccgatttctgcaccgattccttcaaaagaggaatcaagggaatctgaaaaccgctttgccgtctgtttatccatatagaccgagtatgggtcattcaatgttgaaagcatgccctgtatggctccttccaacagtttttccctgtcgacctgctccacatattcatttgaaatcaggtcatatgctttctcaattttctccaattcgtttctagcggtgcttttggctgcagcttcttcagccgctgatgcttttgaaacgacatcatgtaacggaatcgggccggcgcctgttaccaagccgcataacaggctgagcgcaatgatgagccgcacaatcttctgattcatcctatacctcctcttctgcctgcactatgttttgttgcttgatgtagtatgcgccaaaaccgcccgtatcatgtaatcgattttccattccacagcaaaaaaagctgccggagtgctggcagctttcgcttatatggtcctcacgcgcttgatgatttcttctgtcacatcatccgtcgtacttgaaccgccgatatcaggcgttaagtagccgctctttagaacgtcttcaatcacgtcaagcaatcttgcaccgagttcttcttccccgaaatgatcgagcatcatttttgccgtccaaatttggccgatcggattggcgattccttttccgatgatgtccggagcagagccgtgcacaggctcaaacatagatggatatttgccgtttacattaatgttggcggccggcgccacacctatgcttcccataatcgccgccccgatatcggtcaaaatatcgccgaataaattgctggcaacaatgacgtcaagcttctctggcctcgttacaaaaaaggccgacagcgcgtcaatgtgctgcgaatctgcggtaatatcggggtagtcttttgccgtgttctcaaagacttcatcccaaaaaggcattgaataaacgattccgttcgactttgttgcgcttgtgacatgctttttccgcttagccgccaactcaaaagcaaagcgcatcgccctctccgccccttttcttgaaaaaacggcattttgaatggcgatttcatcttcatccctgaagattctgcctccgatcgagctgtattccccttcactgttttccctgacgacaagcagatcgaaatcttttgggttggccagcggagacttgattccttgcaaatatttcgcaggtctaatgttgatgacctgttcaaattcgcggcggattttaatgagcagcccccacagggaaatatggtcggggacaagcttgctgtttcctacagccccaagaaagatgctgtcgaactctttcagctgctccaagccgtcatcaggcatcatttccccgtgttccaaataatactcacagctgtatggaaactccgtaaaccgaaatgagagtcccccgtgaacatccgaaaccgctttcaaaactcgttgtgcagcaggtacgacttctttccctaccccgtcaccgggtatgctggcaatgttgaatactttcattggatcatcccctatttcaaattgtcgactgtcgacagttgtcactttcattctataccttgtgttattttctgacaagaataaattttgagaaaaacccagtttgaataacaaaaagccgattcagtccatctccggacgaatcggctttcattttaaagcggtatataattggccggatcaacagcattggatttcgcgttgttccaaaggcctttatgaatttcaaagtgaagatgctgcccgtaggattggcctgtatttcccatcgttccgatcacttgtccctgttcaacacgctggcctgtctgcactttaattgaagacatgtgagcgtagaccgtctgatatgtttgcccgttgatgttatgggtaataaacacaacattgccgtagctggacgagtaatgggcgttatagaccgttccggcggcggccgcataaatcggaacgcctgaaccgcgcttggcgatgtctacgccgaagtgatttccgagcgaacgctttccgaacccggaagtaaatgtgccggaagcagggcggataaagcctgagctgcttggtgccgacggtttagatgaggaagcttccgattggccgcttgaagcctggcggctcgcttcagcttcctgctttttgcgatgcgcctcttcggctttgatcgcttcatcctggcgctttaaaatttctgcttcattttcgagtgaaccaagttcttcatgtgcatgatctttatcttgcttcacttttttcatgacatttgctttctctttttgctgtttgtcgagcgtcttttttaaatcttccaggtctttgagcgctttttcaaggctttcaaggtccttgctcagcttagtttccttttcctcgacaagctgaagatcgcgtttttgctcttccatcaggtctttatcagcttctacaattgtcgaaaccgcacccgcgcggctgatgaaatccccgaagcttttcgagccgagaagcacatctatgtattgaacagaaccgccgttttcctgcattgagcgaacacggtctttcaatattttattgcgtttctcaatcttttctttaagcttttttatttgctttttcagctcttcgatgcttttctttgttttatcgatttcttcatttttcttttccagcttttcattcgtgtccgtcatcttacggtcgattttctcgatctcgcttctcaggcttgcttcctttgattcaagctctgaaagctcctgtttcgttttttcgagttttgactcgttttcagattttttgctttgaacgtcgctcttttttttctccaagtcttcataagctaaagcatggttgctttttaaggggatcagcactgccgacgatccgagcacagcggtcagccccagcgtcataagctttcttttcaaccttggttcctccttgccttcagaatcaagggagcccggcgctttgcaggcatcccagctttaaacatgatacaaccggcgaaagcgccggtttaaacttttaagaatttgcgaatcgacatcaagcttccccatacaccgataacggctccgatcagcaccaggatcgctgaaatctggaagacgaacggattgtacggcaagagctgtatgaaagtgccttgaactttcggagcgatccactgaacggcatgatgatacgttccgagcaaaatagcgatcggaatgatagaaccgcatacacccaagagcaaaccttcaatgaaaaatggccagcgaatgaaccagtttgtcgcacctacaagtttcataatctcgatttctttgcgtctcgcaaaaatcgtaattttgatcgtattagaaattaaaaacatcgccgtaaacagcaggccgatgaccaatgcaatcccgatgactttggcgacattgctgattttaaacaagcggtctacctgctcctgtccgtatgtcaccttatagacattggtcagcttctcaagcttcttggcagctttcggtgtgtcttgagggtcttttgtttttacgacaaatgcatcgttcagcgggttttcctgctcgaacatcgcaaagaatttcccgtcttccccaaagctgtctttcaggtttttgagttcttcatctttagatgagtatttgacactgctgatttccggtattttctttatttctttttccaatgtatttttttgatcctggttggccgttaagtcaaccagcactttgacttcgacttcttgttcggcttttaatgtcatattgtatacgttcagcatgatgaccatgaacacgccgaccaagataagtgtaactgttacagcactgatggatgcgaaagtcatccacgcgtttctcccgagagattttaagctctcgcgcaaatgccgtccgagagttctaatcataagaaccatactcccctctagcttcatcacgcacaatgaccccgtcttcgattgcgatgacccgtttcttcatggtgtttacgatttctttgttatgagtcgccataacgactgttgttccgcggttgttgatctcttcgagcgtcttcatgatttcccaagacgtctcagggtcaaggtttcccgtcggctcgtcagcgatcacgacatcagggtcgttgacgattgaccgcgcaattgaaacccgttgctgttctcctccggacagctgatcaggaaattgccttgctttgtgcttcagctggacaagatcaagcacttcaagcactttttttctgatcacctctgggcgctccccgatgacctctaaagcaaatgcaacattttcaaacaccgtcagcttcggcagcagtttaaagtcttggaatacaacgccgattttccttctgataaaaggaatctctttttctttgagctgcgccaaatttttattgtttatgacaatcttccctttggaaggcttttcttcgcggtaaatcattttaatgaaggttgattttcctgctccgctcggtcctacaacataaacaaattccccgggatatatagagatgcttattccgttcagcgccgagaccccgttggaataagtcttatatacatcttttatttcgatcatgtaatcacctaatcttttatgtttatacggtcatactcttcgaaagggcctgtcgttttgtgtcccctgccaatttcacgataaatggtattaattcaagccctttttcaacaacacccattatacgtcaagattagacaaaatgatattacagttttgtttcaatgccgacctaagttataggaaaaacgcaaaatcagccaaaaaatttgtactttgggccttatttaagacaaaagaacccgttaattccgttttcccaataggcaaaaagaccttttcaacaaaaaaagaacctttttcacctgaacgtgaagaaggttcttttcgcctcctgactggcaaggcatgcttactttttctctgaaagccacttcgcgaccgcttcagcttctttttcgtctacaagattgccaggcattccgccgcggccgttgactacaatgtccttaatttcgctttccttatacttgccgccaacttccttcaaactcggagcggaaccgccggccaaatccttaccatggcagcctgtgcagttttgctggtaaatctcttccccgtcggttgcagttgcttgcccgcctgtatttttctctttgctttcgttgttattgccgccgcaggcagccagcacaaaagaaacagccataaacagagtaaacagcttcattttcattttttcaagtcagctcctttaacaagtcaacctttattataacctcgattatgcgcgtttaaaaccctcgccaagcacctctgaagcatccatcgcaatgacaaatgcagactcatcaatgtgttttacgagttgtttcagctttgtgaactcggtctggccgaccacgcacatcaaaataggccgctcatcatctgtatagcctccgaccgctgatattttcgtaatccccctgtcgattttattcagtaccgcatgtcgaacttcctcttcccggttcgtaatgatcatcgccattttggaacggttcaatccgacctggatgacatcgatggttttgcttgatatataaacgccaagcatagcataaagtccctgttcgatgttaaaaacaaacatcgcggacaggacgatcgttccgtcaatcagcgccaaacatttgccttgcgacagcccggtgtacttatgaatgatttgcgcggccagcgcagtgccgcctgtcgagccccttccgagaaagaccatcccgatcccgactccgatgccgacaccgccgaaaatggcggccaagagcggattctctgtcgccggagcaatgtcccgcgtcacgtatacgacaaacgggagaaaaacagacccgacaagcgtcttgatgccgaattttcctccgagtaccagaaccccggcaataaataaaggaatattaaatgcccattgcacataggcggcttcaaagccgaacgattgcaaaatggtgctgatgccgctgactccgccggctgcaatccggttgggaagcaaaaacatattaaatgtcacagcgacgacggctgatccaaacaggatatagccgtagtcacgcagcaccgtaaacaattgatatctcgttttgtccatattcatgtctgtcatcctccgcacgattcattaccaatcgagagtatagcatttagcatactgtaagtaaataacagccaaataacgtattaattgaataaagcggcagagggacaaagcttcttacggcttaagctgcccagattcaggcaattttccccgcaaaaaaggcacatcctcacaatgtggatgcgcctttcttcaatttaggaaagcttggaacgcaaatatgcgtcaatgaaagagtcaatgtctccgtccataaccgcctgcacgttccccatttccgtgttggttcgatgatccttcactagagaatacgggtggaaaacgtatgagcggatctggcttccccagccgatttctttttgttcgccgcgaatttcgtccagctgtgcctgctgctcctcgattctgcgctgatacagcttcgatttcagcattttcatggcacgttcgcggtttttaatttgtgatcgctctgtctgacaagtgacgatgacgcctgtcggcaagtgggtgatcctgacggcggagtctgtcgtattgacgtgctggccgccggcgccgcttgccctgtacgtatcgactttaatatcttccgtacggatctcaatgtcgatttcttcgttgaattcaggcatgacatcacaagacacaaacgacgtgtgcctgcgccctgaagagtcaaacggagaaattctgacgagcctgtgcacgcctttttcggcttttaaataaccgtaggcattgtggcctttaatcaggagagtgacagacttgattcccgcctcatctcctggaaggtaatcaagggtttccaccttgaatccgcggcgctctgcccacctggtgtacattctgagaagcattgaaccccaatcctgtgattcggtgccgccggctcccgggtgaagctcaaggatcgcattgtttttatcataaggctcgcttaacaatagctggagctcaaattcattaaactgctttgttaagcttttcagctcgttgaccagttcattttgcaggtcctggtcaggatcttcttttaaaagatcatgtgtcatttgcagttcttcatgagactcgcttaaacttttgtacgtgttgacatagtcttttaacgcattcgcttcattaatgatcgtctgcgctttctgctgatctccccaaaagtcggggtcagccatctgctcgtctaattcgctgattcttgcttcctttgtttcgaggtcaaagagaccccctgaagtccgctaaccgagtagccatattttcaagttcctgtctgatttctgccaattccattattctttcacctcatcatatatttcagccggttcaaaataaaaagaggcgtgcacctctttttattctgttcttccgcagcagtttttatatttttttccgcttccgcagtagcaaggatcattgcgtccgatatccaccgctttgcggaccggttttttcttcgcttgtttttcctcatcgccttctttcggctgatgggctgtcgtctgtccttgaatgacctcttcgcgctcaaggttgttttcgatttcagccttcatgacgaatttggctacatcatcttcaatcgccgcgatcatgttttcaaacattgcaaagccttccatctgatactcgcggagcgggtttgtctgagcataagcgcgcagatgaattccttgccgcagctgatccatcgcatcgatgtgatccatccatttcgtatccacttcgcggagaacgatgactttctcaaattcgcgcatttgttcagagccgtaccgctcttctttctcatcgtatttcgttttgatgcggtcgtaaatgagctctgtaatctcctcgggctcttttccgaaaatgtcgcttttctccactccaccttcatcaaggaaattcgcatttacaagctccacaaggccgtcaagattccactcttcaggcagatcttccttcggcgtatatgaagcaacagcccgctcgagtgaagctttaatcatattttcgacgatggagcggaggttatcggaatcgatgacctcaaagcgctgtttatagatgacttcgcgctgctggcggagcacgtcatcgtattgcagaagctgcttacgggcatcaaagttgttgccttccacacgcttctgtgaagattcgaccgctcttgaaaccatcttgctctgtatcggcgtcgaatcgtccattccgaagcggtcaagcatcgccatcgtccgctctgcgccgaagcgtttcattaattcatcttccatggacagataaaattgggtgataccagggtccccctgacggcctgaacgtccgcgcagctggttgtcaatccgccttgattcatggcgttccgtaccgatgacggccagtccgccaagctcttttacaccttcgccaagcttgatgtccgttccgcggcccgccatgttggtcgcgatggtgaccgcgcctttttgcccggcatcttcgataatctgagcttcccgctcatggtttttcgcgttcaacacttgatgcgggattcctttatttttaaggagccttgatatcaattcagatgtttcaaccgcaaccgtaccgacaagtaccggctgtccgaccatatagcgctgggcgacatcctctgcaacagctttaaattttccttccatggtccggtaaattaaatccggtcggtcatcgcgggcaatcggcttgttggtcggaatcgtaacaacctgcatgttgtagatgttgcggaattcttcttcttccgtttttgcggtacccgtcattccagccaatttttcatacattcggaaatagttctggaaggtgatcgtcgcgagcgtcatgctctcattttggatctcaaggccttccttcgcttcaatggcctggtgaagtccgtcgctgtagcggcggcctttcatcaaacggcctgtaaaagagtcgacgataacgacctgaccgtcttcgacgacgtagtcgacgtctttatgcatcgccgcatgggctttcagcgcctgggcaatatgatggtttaaggcgacatggcggacgtcaaacaagttttcgatgccaaatgccttttcagcttttgtcatcccctcttcagtcagctgaacgccttttgttttcacatcgtatgtgtagtcctgatccgcttttagcgtgcggacaaacgcattggcctgaacataaagcttggtggatttggccgcttgtccagaaatgatgagcggcgttcttgcttcatcgatcaaaatggagtcgacttcatcgatgaccgcaaaatgaagcgggcgctgaaccatctgctctttataaagcaccatgttgtcgcgcaagtagtcaaagccaagctcattattcgtagaatacgtaatatctgctgcataggcttcacgcttctcgtcttttgacaggctgttcaggtttaggccgaccgtcagcccgagaaactcaaagattttccccatctcttcagcgtcgcggctcgccaggtattcgttgaccgtcacgacgtgaacgcctttccctgacagagcgttcaagtaaacgggcattgtggaagtcagcgttttaccttcccccgttttcatttcggcgatattcccttcatgaagggcgacgccccccatcagctgaaccttaaacggaaacatgcctgtcacgcgccgggaagcttccctgacaacggcaaacgcttcaaccaaaagatcgtcaaccgtttcgcctttttcaaggcgctctttgaactcgatcgtcttttgcttcaaagcttcgtctgaaagcttctctatatctgccttgagcgcatcaatctcgttcgctttcttttcataacggctgagcgtgcgttttgtcggatcaaacactttatttaaaattccaagcatagaataacgctcctctttaatttccttgtttaagcatgagtaaacagtaatttttatatatgcaatatcatatcataccttttgtcatttccaaacaatttaccgcgggggaacggaaaaaatcccctctgcggaagatccgggaggggactcgatatatttattcgttcggctcgatcaaaccgtattttccatcgtttcttcggtagaccacattggtcagattggtttcggcgttcgtgaatacaaagaagctgtgtccaagcatattcatttgtaaaatcgcttcttcattatccatcggctttaaattaaagcgcttttgacggacaacctgcggctgttcatcctcaatgtcttcctgcacggccgttccgatgccgtttccttctgcaaaaacatgcttcgaagaacctttttcgcggaatttccggttaacttttgttttatgcttgcgtatttgacgttccagtttgttcgttgcgagatcgattgcattgtacatatcttcgtggtgaacttccgcacggagagagaggtctgtcattggaattgtcacttccacctttgattcctgatcattgtagaattttaagttgacgtgaacaatcgcatcaacgttattttcaaaataacgctcaagctttccaatcttcttctcgacgtgttctcttaacgctggtgttacctcaatattttctcctctgacgttgaactccatcaaaagaacgcctcctttatattaaggatatgtaaatatatttcgtcttttccctgctgaattcctgcataaacgtaaaaattatgtgaaaaatccgtgaattttgacgaagtttgtctcctgccatctgagcccctttattaaatcttaaatatattcacatgcggataaaataagaacaaaaaataacggcatacacctgcagaatcctgacagatgtatgccattaatggatgacataaggtttcatgcattggtggatcgttttcatccattcccgataaagcggtaaaaagtgatggatcaagtcatgctgaaattcagcagacggataattgtagtagatcaagctgtcaaactcacggaagactctgtcaaaaaaacgaatcgaagatttggcacagcttgtctccaaaatcgacagcaaaacagcgtgcgacgaatccaactgaaaaaaagcatagattaaatcgttaaaaatccgctctccttctgtcttcgccaaatcttgattcgcttctattaaatagcaaaacccctcttcaatcgtaaacaaaagctgataataagtcgttaagagcatgtaatcgtcggtgcttgtcaaagcgatcacctatttgcgcttgtcataatatgtgccgtcaatcgtcatgttggcgtacggattgatataggaatgatgcatggcacgcttctgcttcgcctgaagcagctcctgcttgacagcctgctgcagccttttcagttcggccatgatcaatggctccatatccgtcacctgctgcagctgccgcttttccgtctcagaaagaggcggcttgatctcgcggatcaagccatcgcgttttttaagaaaatcttcaattgcctgaaccagctcatcgctttccggggcgccttttatttgagcgagcatatgttttgtttcgctgtagagcagctcaatcttttccattatgccagtccgcccgatccgaaccggccctgccgttcaatttgaagcgcctgcttccaggcatcgcgtaaatctttgacatacccttcgacttccgccacgatatctttgtcattgttaatgtttgcttcaatcaggcggcggtggatatactcgtacatcgcccccatcgaagcggccaattcgactttccgatcaagggtgatattgagctcctgtataatgttttgagctttgacaaggttcgtatttttcgtttccatatcctcttgttcaatcgcctgtttcgccagcttcataaatttaaggcagccgtcaaatagcataagcgtcaattctccaggagtcgccatgttgattgaattttgctgataagctgcatacggattgtttaaagccattgttgatcctccaaattacaattattgtccaagcaattgcgccaagtatgtcgattgttcattcattttttgaatcgctttttccatcgccgtgaactttgtataatagcgattttcgatttgtgtcaggcggttattcatggacgaaatatcagattcaactgtattcaagtttttcccgattgtaaattgattgtttgccattgctgaatttccggctttatcttcaatctgcttcttcgtatcggtcaaaaccgtctgaaggcgtctcatgatgcctttttcattgtaattttccgtgctgctcgttcccgccataaagaggtttgccacactgtcagggtcttctttaattttcgctttcagcttttcttcgttgatctctaaatgaccgcgctgactgtatacgcttgatgtcgtaattccaaactgagtgagctgcagcgattcgccgttcacagagacattcgaataaaaatctgtcctcatttgattggtggcgccgcttaaaatcgtgtcgccccttaacaatccgcttttcgctttttcttcccacagctcaatttgcttttccgtcatatcttttttctgttcttctgtcagcggcgtatagtcgcggtatttcttttccgtgagcttgccgttgaccatatcgatcagttcgttgtactgtgtgacaaagtctttaatcttttcataaatcccgtcaacatcagtcgctacatcaagcgaaacggggctgtttgtcgtattcttcaactgatatgtcacattattaacggtaaagttgttcgttgtcttctcaatctgcaatccgttgatgacaacttcggcgttttggccggcttggctggctgtcagcttgttgtcggcatcaagcgcaaatccgagctgattggacataaagctcgccgtcgcatcatcagctgcctgtatgctgccccctgcgccggttgcttttgatgtgaaagcgatcgtttctacatattcagaaccgttataaatcttttctttcatagcggttacgcccaaatttgatttgttgactttggaaacgatgtcatccagcgtatccgtgctgctgacgctgatttcaacttttttcgcagtcgtttctccaggtgctgtcacttggaaagttagcgtttgatcgctcccggtataccctgaaaggctggaagatttataggtggccgcagtcgccagcttgttgacttggatcgtgcctgacgccgcattcgtggtgcctgttgccgtaaccgccgactcgtcagagcttgtcacctttttcgcgccgtacgtgctgggacggagcataaggttgatggattcctgcaaatctttaattttcgtattgatttcacgatagctgtcgcgctgccattccaaagtctgtttcttttgagtaagcttatcaagcgggacgcgctccgtcttcattaatttgctgacaatgtcgtctatatccatacctgaagctaatcctgatattctgatcgccatttctttaacactcctgttctatgtagttttatcgacaattaaccccataaattccgccatcgccgcataaaaatcgagccactcctttggcggaatctcgcggacgacttcctctgtccgattgtccacgaccttcacataatactctcccaatttttcgtgaagcacaaactgtaggtgcacctgcgacggctccaaaaggttgtttgcgccttgtacggttttttcaagctgagcaaatgtaaattctgcagcgtccgtctgctgcgggcgttccacagcttcatactgtttattcaacatctgtgttttgtaagcatcaataatgggttctaaagatgacaatctattgatcgacaatttttaccatcccctatgctatgatctaaaacttatatcggctaagggcgaatgagattaaatatctttatggaaaaaaattatgagaaaagacaaagtggtttaattaaaaaaaagaatccctgcaaaggattcttggacaaatgtaaaaaaagaccttggcaaaggccaagatctttttaaaattaacgaagcaactgaagaacgttttgcggctgttggttcgcttgagcaagcatagcttgagaagcttgagaaagaatgttgttctttgtgaactcgctcatttctttagccatgtcaacgtcgcggatacgagactcagcagctgtcaagttttcagaagaagcaccaaggttgttgattgtgtgctctagacggttttgtaccgcaccaagtttagcacgttgtgcagatacttggttgatcgctgaatcaacgattttaagttgagtatcaaaacctacatctgttgcagttgctgcattatcagcaaatttagttacatcgatatctttaactgattggttggttactagagttctgcccgtagtatctgcaggatctttgactcctaatgcatcagtgctcattttttcaatgttaacagaaatttgttgtgttgcgttagctccaatttggaaaactaaagatttttcacctgcagctgggtttgctggatctgctggtgctttgaaagtaccatccaacaattttttaccgttgaattccgtacgttctgagatgccgtcaatttcgtcttttaatgctttgatctcgtcttggatagctgttaaatcctcagtttgttgtgttccagtgtttccagcttgaacaactagttcacgaacacgttgaaggattgagtgagtctcagtcaatgcaccttcagctgtttggataagagagatgccgtcttgagcgttcttagaagccatttcaagaccgcggatttgtcctctcattttttcagagattgcaagacctgctgcgtcatctccggcacggttgatgcgaagaccagaagaaagcttctccatgttcttttggcttgcgccgttgtttgctgacagacggttcagcgtgttaagcgctgcaatgttgtggttgattctcattgtgtatttcctccttgaaatgtgtttgattgcacgtccatgtgcatgtttgaagcattcaggctgtccttcctgctacatattttatatcggaggtgccttgaaattgtttatagcaaaaataaaaaaatcctcactttttttgtgaggataatttcgcaagcaaatcgtttgagatggaagcggcccggctgttttcttcctggatcgccaaatagatttccttgcggtgaatttcgatatgcttcggcgcgtcgatgccgattttcacctgatctccgtcaacggatatgattttcacttcgatatcgtctccgatttgaatcgcttcattgagcttgcgggataagactagcatgcttcccctcctatcggctgctttgtcagataagaagagtcatgcaaaatcacttgcttggcaagcatctttctgcggttcaccactatcggcgccatcaaattggccgttgatttctcgaatggctcttcgatcgttaaaatcgccattacttcaacgtcttcggcagattcgatttcaagaagttcaaccgtcgtttcatcaagatcaaagccataatctttgaaaaagacgaacggactggcgacaatgaatgccagctcttccgactgcaccgactgaaggacgacgaacggcgaatcctcggaaagcggcaggatgacgaacttcttctcccctgtaaatccaggcaggccgtttttaaacacgattgtctggtcttcttgaatttgcgtttctccgtgatactttgttttaatgatcatcattcacgatcctttgctgaattacttttgttttgggtattccacatctatttttacctccggatattggagcatgtcaaccttcacactgcccggcgtatagttaacaaccggtttattcggcgttgcttcgatgataggcttgcgcggcgtcgcttcaatgttcactttagccggttcgtatgcgattttcaccctgtcaaatgacggcgtaaaatgaacgccgatttgaatcggttcaggctcgctgttccgcctcgcctggtctgcaagcggattgccttcgatttcgatccgcatcatttcgtctccttcttcagcggtccgtgccattccggcgagccaatcctgatagccctgctgcgccccttcttcaatccttttaaatatatgctttctttctaagtcttcccaagcttttgtctggtcaatcgtgagctttgaaggggtggttgtaatcttcagttcggccggcggctgctcgattttcaagtcagcgcgcggctgttccattttcaaatctggcggcgtcgttgttaaaccgatgcggccggggatattttgcatgatcagcctaggcatctccattatgatatcctccttttgctgaaaaaaagcaactcggatagagttgcttttatcttaaaaagtcaaccagtgtcggctgaacgattttcgcatttacggcaagtgcagctctgtgaaccgattgctgtgtaataaattcagtaatgatctcctcaagctcaacatcttcgttgtctgacaatacctttgtcgccgtctcttcctgttcgctcagccgcgcattgatcaattcgagccggttgtagcgcgctccgatatcagaccgctcattgctcatctgattggagaactggtcaatgtctgaaagggcgttttccattccttccattgttcccgcttttaaggcattttcgagagactcaatcatttcaaagacgttttgtccgctgcttgattgtccgccgaaagccgaaatcggatttgagtttacatttaaggttgcgtttggcgaaacattgatgagaacgtcagagctgcttgtatagttttcaaaattgtatgtgtaagtaccatcggcgttttttgtgatcggagcgacgtcagagttcgttccgttaaaaaggtagcggccgttgacctgcgtattggcgatctgaatcagctggtctttcagttggccgatttcgaccccgatcgcatttaattcatccttgccgtttgtactgttttgagccttaacggtcagctccctgattttcgccatgatatcaatgccttctgtaatgttcgtttccgtgttttcaagccatgtaaaagcttgcgaggcattgctttgatattgtttaacctgggacagctgtgtattgtacttcaggcttttcatcgcgacgacgggatcgtcggatgcctttgtgatcttttttcccgaagaaatctgggattgaagcttatccagttttccatagcttgaattgatgtagcgcaaagaattttttgcaatcatcccttgggttacccgcatgaatctctacctaccttcccacgacacccatgccgttaataatcttatcgaggacttcgtcctgcagcgtaatcattctcgcagccgcgttataagcatgctggaattggatcatgttcgacatttcttcgtctaatgatacggcgctaacagactgtctgttcaattcagcagtgtttacaagcgtttctgtatttttggccagtctgtttgtttcctgagcttttacgcccatttcaccgatgatgcctgcgtaatagtctaaaacggtcgtcgttttgtcaccgatttgaattttcttggtgaagacattagcgagatttgtcgcgttggcgttgtcgctcgcttcaccattcagcgatgcggcgactttatcgccttttgaattcatgatctcatcggctactttgattttgccggcggctccctttgcaggctcagcctctcctccggtaaattcaaagaaaatgcctcccggttctcccgatgaagtaaacccgctttgatggactgcattaaactctttcgcaaaagcaagcgccatcgtatccagatctgcgagcatttcgggatacaaacctttttcttcaccgtttgacatatatccgtaagattcgattaaaccgagcagggaccctttgctagtaaacgaatcgatgccgatgtccgtcccgccgagggaaacgcccgtcacaaggcctgtatcgttgtcgtaattcactttgacagtttcagtcgtgaagtttggcccgtcaagaaccttgcccagagactggccgtttacgtcaaggacttctattgacacaatgccttcagcggttgcgagtggattgccgccggttttcgcatagctgactttgatattaaccattgaagacagttcatcaaggagctgatcacgcttatcgtacaaatcgttcgggagatagccgttcggctcgactttggcgatttgctcgttcaagctgttcagctgggacaaaagcgagttaatcgtcatcacattttgatcaatctggtcgcctaaatttgattgaacggttgtcagcgattcatacagagtgttaaatgtatcggcgaccgcctgccctttttgcgcaacaacagaagcagcgctcggttcgtgggcgttgttcgtcaattcctgaatggaattccagaatgaattcagaactttgtttagtccggtgtcgttcagttcattcataatcccttccatttggttaaaagcgtccacttttgcattgtaatagccggcctttgtattctgcgtcctgtattgatagtccagaaagctgtccctaaccctttcaaccgaaccgatttcaacgcctgtacccatctggcctgcaagtccgacagagtctcttgatacggacggataaggggttgatgctttaaatgtaacacgctgtcttgaatacccttcggtattggcgttggatatattgtttgctgtcacgctcagagctgattgctgcgcggacaagcctctttttgcgatttccagccctaaaaaagttggatttgtcatctttttcactccgttctaagcttttgaatcgaataaagaaagccgtttcaccccgcctgtctggtttggctgctgctcttttccgtaattcgaaccgccttcattcggaaggagcatatcaaatgtaagcgagataaattgaagcgactgaaaagtcagctgcttgttcaaatcgttcacatccttcaaacgggtgacgagctgtgagagcttggcatacagctgttccagcacctttttctcgccgcccgcagctttgctgatacatgcgctgatcgtcgcgtccgagctgccgatacagcttttagttgcttcaatgcgggactgctccgtttgttcaatggcctgcacatacttttgttctttcgtcacgatttctgaaagtgcctttatttcgttcgtcttcagcgcctccgttttttgttccgacagagacagcagatgttcatgcagcacgcataagcgctccagctcttcaatcacccgtttcactgaactgacttcctccttttattgctgtttataaaaattgaccattttttcagctatgcctttgccgtcaactttgtacgttccattctccacggctgctttcagctgggcaattttctcctgacgctccttcattaaatcagggcctttttgcagctcctttgctttcgcggaaatctcaactttgtcttccggctgggctgctccctgtgaagaagctgtttgtttttcaaatgatttatgataaggattaacaggttgtgttccatattggttgatcttcatgggattcctctcactttccgccatagttatctatgatcatactcattttatcgtctgagcttcaagttagtttagggaatcagtcatttttgggcttaaaggtatagtacgtgcctttagaactattatttctctctctttcaagctgctccagctggtctaattgactcatttgcgatgccaaatcctgctcgcatgacatgcaataacgtccttcccgaataagcgtgccgcacctttcgcacggatagccgagattcgggaaattagagatttgaatgcgtttctgtctaataaacttcaatattaactcttcttcgacacctgttttttctacgatctgaaacatcgtggactgccggttttcctgttttttcagaaatttataaacaatttcatacgcgcgctcttcttctttcaagcatgaagcgcaaacggtttgaaaactgcttttcataaacaatgcgttacatcttggacaattcgccaattgactcataaactttgacccctatccttaaattctattttttatatcggcagggaagaaaaatgatttagcttctaattaatgtatatgatgatacagattttgcttctccggatgtcatcaggcaatcagcggcatgatgaagggtcgctcctgtcgtatacaagtcgtcaatcaatatgacatccagattctttactgaccccttttcggttctaaaaacggtttttggcttaattcgctctttcctgctttttttggattgtttttcattttcgattctgatcaagggatgaataacgggtatttgtaataaggaagcaagacgctccgcctgattaaatcccctctccgctttacgttcttcactgagaggtatcggaactaaaacagacgggctgcggcggaagtattgttgaaaagcgctgataaatgaaggggcaaaagcgaagaccagttcagcatcacctctgaacttaaaacgggcaaggacttctttcatgaaagtattgtagagataaacagagcggttttgcctcaaaagagagcgggttaacggattggcctcccattttgcgcagtcaccgcacagctcttcgctcccctgtggccgtccgcacttagggcatacggttcctttgatctcgataaagttctctttacattccctgcatattttctcttctgatcgtaaaaagaaaaaagaatgccatgagagagaatgtaaaagaggcgctgcacaaattaaacaattcagtttattccctccctcttcgattgcttgcgcaaagcgggttttcattcacctttctggcagcttcagccaaggtgacaagcattgatgtattcttttgtttgtcaacgagctctgcttttatgtaagccagcttcgactgatctgttacatattgcggttttactgcatttaaagccaaggcgagcacatcctccctgcacctgctgcacgtacagctcatgtgcagctgatcgatatactgatcaaacaactcttccaaaacagcttctttggcgttgactagcatccggcaccgctcctcattttatattcataggtatactttaccatgaatatcagactagtcaatcaacatttcctttttagacattttattcatgttttgaatatgacgtcgtgccgcattcatcgactttgtcctgccgtaatgaaagaaacagacgtctccatctgtgtgctcgggatgcctgccggctcttcccgccatttggacgagggcgctttcggtaaaaaccgccgactctgcccccaatactccaacctgcgcttttttgacggtcactcctctttccaaaatcgttgttgtcacgagcacctcaagcttactttccctaaaccggttcactttttcatttctgtcagggtcatcggcataaactccttcagcgcgaaatgtttcctttttcagcacactgaccacagatttaagaacagggacagagggaacgaataaaaaaaccggttgctgcagttcttggtgcttaaaaagccattttttgaggcgaaaaggaacttttcttcgtttcaaactctttttccaatttccgcaccaaatcaatgtaggttcaggcaaggggctgcggtggaatctcgcgggaatacggacggtgtccagctttccgctctcagccctttttttcatatctgctgaaggcgtggcagttaaatagatgtgagcgctttgccgttttgccgattttttaacagcgtattgcagcgtgttatcaatagaatacggaaaagcatccacctcatctatgatgatcacgtcaaatgcttctttatagcggagcagctggtgggtagttgaaatgataagcggcgagagattcccaacgtctgagcttcctccgtacaaagcggcaatttccacccctggaaaggcttggcgaaaccgcggagcaagctcgagtacgacatcggttctcggagtagcgatacatactgtcaagccgttgttcagcgcgaattcgatcccttgaaagagaagttctgttttccccgacccgcaaaccgcccagaccaacagttcttcttttcttcgtatagcattgataatggatttggccgctttctcctgacctgctgaaagcgcgcctttccactccgtatgaacaggcgcccatttatggctgacatgcatgtgccaagtcaacagaggcgtacaatcgctcaccctgcccatcatgacgcaggatcggcagtacacgcagcatttactgcaccgatagcaaggataccgggcgaaaaatgagcgttcgtgctggccgcacctcaaacaaataaagcctttcttcgtttttttaataccttcctccgtttttatcaagccttcttggatatgccaatcaacgacggattcacgaaaaggaagttcgcttttcagaaggtggcgctgctccaaacatgaccgcaattcacgggtatagaatgccggttgttcgatgtgaatcacctccaatctgccatttagtatctatcatccatggtttcttgtaaaacagtcaaaatctaaaaatctcccttcaaaacagttgaaaaaaaaatctccgttttgcaaaacggagattggcttttatactgtataccaggcgatacccatcgctccttcaccaaggtgagtgccgatcacaggcccgaaatagcttttataaaattcgacatgtgcatattgcttcgacaattcttcgattatttgatcggcttcttcttcacggttggcatgaatcacaaccgctctcagcggctttcctttctcggcatcttcgccaaaaagctcaaataaacggttcatcgctttttttctcgtccggattttctcgtagggaacgatcagcttgttctcaaaatgcaagatcggctttacttttaaaaggcttccgacaaaagcctgggcgccgctcagacgtcctcccctttgcaaatgtgaaaggtcgtcaaccataaaataagccctcatcgaggttttcatatgatccaagtggcggatgatttcctcaggagccgctcctttttccgccatctcagccgcctcgatcgcataaaaaccctgagccatgcagctgatttccgaatcaaacggatacactttaattccttcaagcataccgcttgctgatacagcgctgttgaatgttccgctgatgccgctggaaaggtggatgctgatgaccgcgtcatatgtttcaccgagtttttcatagagagaaatcaactcgccgtaggcgggctgggaagtcgtcgggagattttcgtgggcttttacttctttgtaatagtccttccagctcatatcgatctcttccctgtatgaagtctctccaaagatcacattgagaggtatcatatgaatattgtagcggtcacgcaggtctttaggtatatatgccgtactgtctgttactactgctgttttcatgaaataaaccttccttatgaaagatactcttttctattctaaaagaaaaagcagcttttttcattataaagtttaattttctgccaaaagaaaagacctgccttatggcaagtccatctttatctcatttctacccagccgtttttaatggctacaacaacagcctgcgttctgtcgtttacattcattttttgaaggatgttgctgacatggtttttaaccgttttttcactgataaataatgattcgccgattccgcggttgctttttccatccgccagcatctgcagtacctcgcattcccttcttgtgagaatgtgaagaggtctccggatttccggatacacctcatgctgagcgtgagatgatacaccgcttgttgcaagacggcggaattcattcacaagattgtgtgtaaccttaggatgcagataagatccgccttcagctactactttcacggcttcgatcagcgtatcggcatccatttctttcagcagatagccccgggctcctgtttttaatgcatgtgtaacatagttttcgtcatcatggatggataaaataataacctttgattccggatacaagtcgaccagttgttttgtcgcttctactccgttcacattcggcatattaatatccatgataacaacatcaggatggtagtgctcgacaatgcgagccgcttcatctccgtcgtctccttcggccactacctcaaaggtaggttcgaaatccaaaatccgtttgacaccttcacggaataactgatgatcgtcaataattacaatatttactttagtcacaagctacgcctccccattctcattgttaaacacaccgcttttatggtcaatatgtcttttgtctctattttacaattatctttacaaagacagtggaactttaatcaatataaatgtcccaagacctattttcgaatcgattgtcattgagccttcgagcaaatcgactctttctttcatacctagcagaccgaaagatttgttcttcttgccttttacttcttttaagtcaaagccgtttccattgtctttgataatcagcgtcacaaaatcttttgtcacttctactttaacatgaatttcagttgattcggagtgttttaaggcgtttgtcaccgcttcctgtgcaagccggaatagtgcaacctcaaaccgcggtgctattcttctttcttcggattctccgatgcattggaaatgaatctttgcttttccatgataatcttcgatcgtgttcaagtattttctgagcgtcggtatcaatcccaaatcgtctaaagccatcggccttaaatcataaatgattcttctgacttcataaagagcatttctgacgttttgccggaggtttttaatttcctgaaagccttcttctgttcctttgtctctgaagatgcgttcgatcagttcagatctcatcataacgttggccagcatttgcgcaggaccgtcgtgaatttcccttgagaccctttttctttcttcctcctgggcttcgataatccgcagtccgaaatcctgcttggcctgcgcatcttcaaggagaacgccgacctggcgcagatcctgatttaagtagtttaagacgacggtaatctgactgacaagcccttctgaacgctcgatgatttcctgaagccccaaaaggcgccgttccagatcatcacgcttctctctcagctgcttttcccgctgctggatcattgtcagttcaacctgcagtttgtgggctttttcataagcttcgcgaatctcttcttcactgaatttatgaaagtttctgctgacctctgacaagcggttccgcgcatggcgggcatgcacttccagcctgtctccaagatcgatgacttcgttgacctgctgtttaatctgtttcagctcttctaccaagccttcgtattgctggcgggactgctctccgatttgaaagacttcatccttgctcccgtcaaccgtttttaacatcttcataatgattgaatctaaaactttggagtccattttggaaacgctcacccattttccctccgtaacagcattgtcatttagttttatcataaatttcattgaactgaaattcgtgtcgaattataatgaaagaatgcgtattctggtttttttatggttaccgatccatttctatttaatcataacaaaatacgcgccaaaattctaagtctgttcgatttttaggagaacagccgcaggcttgtcaggaggtaagcaggcatgctgcaaagctatctgactgttgcaggtgaagggacccatgaaatcgtgattgaaaaatcccggtttatatgccacttgagccgcgtcagtactgaagaagaagcacagaactttatcaaccacataaaaaagcagcattggaatgcgacgcataattgctcggcttacgtcataggagaaaatgatcaaattcaaaaagcgaatgacgacggagaaccgagcgggacagcgggcgtaccgatgcttgaagttttgaagaaacgcaaccttaaagatacatgcgccgttgtgacgagatatttcggcggcattaaactcggcgcaggaggattgataagggcttacggaaaatccgtgtcagaggggctgaaccatgtcggcgttgtcgaacgaaagctgatgcgggtcatgcacaccactgtgaactatacatggatcggcaagcttgaaaacgagcttcgcgagtccccttatcaaataaaagacgttcactatgcagacgatgtcgaatttgaaacgtatgtcaaggaaagcgaaaaacaggcatttacggaatggataaccgaattaacaaatggcaagagtgagaatagagaaggcattcaagtctatttggaagaagcttttaataattaaaggagaatcatcttatggctgagcgtattaaagtgaaagtgcggaaaaaaaagaataaaaagagaaggctgattaaacggtttatagtccttatgctgctcgcacttctcgcagtcggcggagtgggcatatataaaattataaacacgatttccgcggctgacggcacttatgatgagcttgaacgcggagagaagtcgaagctcagggacgatgttgttgatattcaaaaaaagccgttctcgattctttttatgggggttgaagattattcgacaaacggcgagcacggccggacggattccctgattgtcgtgacgctcgatcctaaaaagaagtcgatgaaaatgctgagcattccgcgggacacaagggttcatttggccagcgacacaaccggcacaaaaacaaaaattaatgcggcctatgcaaaaggcggcaaggatgaaacaattgagacggttgaggatttcctcggaatcccgatcgactactatgcaacggtcgattttgacgggtttaaagatgtcatcgatgaaatcggcggaatcgatgtcgatgtgccgtttgactttagcgaaaaaagcgatgtctccaaatcgaagagaatctattttaaaaaaggaaatatgcatctaaatggtgaggaagctcttgcctacgcaaggatgagaaaacaggataagcgtggagacttcgggagaaacgacagacagaagcaaattttaaaagccgctcttgatcaaatctcaaaaccgcaaaacctcgctaaaattgatacaattgcccaaaaagcaagcaaaaacattcagacgaattttagaatcacgcaggcgctggcgcttcaacaaatttacagcggctttgccggcgatgatatcaaaacattaaacatcacaggacaggatcttacgattgcaaatgtttactactttgagcctgaccagcaaaacctggaaaacgtgcaaaatgaattgacccatcatttgtacccggactcagctgccgattcgagcggaacatcgtctgaatcttccgcaaccgctgacggtgcggacagctcagctgaatcgtctgctgcttcttattgatcggctctgttgaatgttaaattcataaatgaataaattgaaggggaactctttatatatttagggttcccctttctttttaagctagcgtaacttactatttgaacaaagcaaatgattgatcatactatgctttaaataattatactgtttttcgctggtatctgagaatgcctcgtctctatttgagggaatatccatatacaggatgtcttctttgaattgagaaaccgttaaatcatatcttttaccattgacaaaattataaaaatgccacccttcaggcagctttgttttctttatttctccacctaatatatcatttacgactagcgcggttacgccgcattgtcccttggcagggttatccttactccattttgaacttgaatctgaagaccaggatttatacaatgctttcactatttgttcgatttgtccaaggtaatgatcatccataaataaccctccttttcataaagttttagttattcagccattattaaaaacccgcttatgatacttccggaaatgcggtaaaaataaaacccctggaaaccaggggttttttgcgttcattaattcctcttcaccatccgcctgtaaaacttcgtaaaaggcttgtactgctcatttacaaggcctgtcacctctgcgattatctgcatgaacagtattaagccgaagatgatgaagatggacacccatagggttgcggtttttaaaagaatggcgctcaggctgaagacgacgccgattaaataaatgacgataacggctttccgatgggacaggccgaaggccatcagcctgtggtgaatatgcgatttatcgggagccgaaatcggctgcttgtttaaaatccgcctgatgatcgcaaatgtcgtgtcaaatatcggcactcctaatataataatcgggatgacgacgctgaacagagtcacgcttttatacagccccagcagcgacagaaccgagatcacatagcccaaaaacagcgagcccgtgtctcccataaaaattttcgccgggtggaagttgtagaacagaaagccgaccgtgcttccgatgactaccagcgacaaagagaagatcaagattttatcggcagaaaacgccatgacggcaatcgtcgagaggccgatgacggatatacccgcagccagtccgtccaatccgtcgattaaattgatggcattggtgatcccgacgatccacaaaatcgtcaacgggtatgcgagccaccccaaatcaaagcgaagatcccaaaacggaatcgataaaaattccattttcaagcctgtactcacgatgatgcaggctactaatacttgtacgataaatttaattctcgcgcttaaattgtatttgtcatctacaatgcctaaaattacgatcataaaagcaccgagtgtaattgctgttattctgttttcataaaggccgccggcaaacgaaccggtcaatactcctataaaaatggctaaaccgcccattctcggcattactttatcatgtatctttcgtttatccggctgatccacgaccccggatttgattgctagacgtttgacaagcggagtaataattaaaacagtaatgagagagacaaaaaacgcaattacagtgcgttcataagacataaggaagtctcctttttaaatgaagtctggtcgtataaaagatcataccttttcattatacaatttcattatttattataacaagctccagccaaaagaaacatcacgaattaatatcccccgccgcaaattatgcatccttattcaagttcaatttatcaagcatcattaaaaatagatgatgccagtctctttcacgtgcgatctttctgcgcagttccacatgggaaacatcatcatgcgcaagctccagctcttcacaaaccgctgtaaattcagcggggtcgtttcctgttaaatgacggtaaacgtgttcctgttcaaccttttccgttgaagggaggttcatacctgcgacaggctttccggcagccaaaaattcaaacagctttaaaggaaataccgcattgttatatggcgacggtttatacggcatgataccgatatccactacattcatataagctggtacttctgacggcgcagcggggcccgtccagatgacattatcttcttcaagaagcgctttaaaatcttcgtctccgtttgtcccgtcaggaccgacaaataaaaatgtccactctttttttgttctggcagcttctttgacgagcttaaaatcgagcttcggcttgattcctccgataaagccgaggacggttccttcccttcccttcaatacatccgctttttgcatattttctgcaaacaagctgtactccacaccgttttcgattgtaaaaaccggctttgtctctccttgaagccggtctgctacattttgttgcaagtattcggaagtgcaaaaaatcgtatcagcagctttgatgattctgccttcagcttcaaaaatgaccttttgcctgaatcctgagacaaggctttggctaccgctgatcggggccgcccacaggtcgctgcagtcatagatgacctgatcccattgataaagcgacgacagcagcggaaagccggggaaggtgtaccataagcacaccttttctccctgaacgtcttctttcagccggtcaagcagcggcttcagcttgctttgatagaaaacatctttgtagcgggcaaacctgaatattttctttttcaaaaaatctttgactgcaaattgcttgattccgttgtcaagcaatgtaaaagtctcacgggaaggattttcagacggacaaacccaaatgacttccttcgtctccttgcggcctgctaaaaactcagcaaggcggtgccttctgtatcttagctgatcctgcccccattcacctgtcgctactatgacgtgtatgaattgatctgctttcactttcaatcaccttttctgtcaatgccgttataatcttttcattactgcgttcttagcgtaatggaaaaagcaccatgtcgctttcatcaagtgaagtcgttcgatttccctgtatacgtaccaggtttttcgcgccgccttccacttgtttctggagatcgatgtttcaacgatgcggtattccgcgaggggttcgttcagtccatatgccttgaacccccgctttaatacggacagccatgtcgccaaatcctggcgggttctaatattcggcatccggatatcacccgtttgttctctgtcaatcatcaccgtcaagcagccgatgatcgtattttttaatacatcatcatatgtaaggcttacgggtgcatgaatggttttatgaagcggttcgccgtcttggctgatcagctcgtatgccgtaaatgagaaagcatgctgatgctttctcatgaaggcgagctgcttatccagcttttctgctttccaaacatcatcgctgtccaaaaaggcgacatagcgcccttcggctttgctgagcgccgcatttcgcgccgctgcagcaccttgattctctttcagaaaaatggcatggatccgctcatcatcttcttcatagcgcttcaaaatgtctcttgtcccatctgttgagcaatcatcggcaatgatcatttcccagtcggaaaacgtctgatttaagacggacttaatggttttttcgataaattcctccgcgttataggaaggcgtaatgacagagattaaaggtttttgcctcgtcatggtcctgatccacatccccaattaaaaatttaacgttctctgaaaacttccggaatgacaatgataaaaaatgacagcgctaaaccgatcagtacgcccagcaccgctcttttcttaggcgacatgccggcagcctggttatcaagcacgatcaacggctcaatttcttcagcagccttcatatcaagcttgcttgtttcaagctcatacaaaaaccgctgtttgtcaactttggaatcagcgctgactgtttcgtcttcaagcgccttaatattcttttcaatgacttcttctctttttgagaacagcgccttatcgcctttcatataggcatctttaatttttcctaaagtatccaatgtttcctgtttatcaggccctgtgtagcttaagttgaaaagtgaatccgttctgatttcaatcgccagatcgtctttcaattgcgccagatcctcttccggcatatccgggaaaatgtcctttaaaaaagcttcgtttttcaacagcagcggcacttgctttgcattgttgtacttcgcttctccatagttcccggttgatatcgttacagtagccgtgtaattagatggagcaacgcttcccttcggcataaaatagccgacaagaccaagaataagaggaagcgcaataatcgccacaataaactttttcactctaccagcaatacgtttgattaaattcatcacatgaatttctccctgtttttaaattcgattttcaaaaatcacctatactgttcggtttcatccgttccgcagactctaaaggtattaaccgtcgcaatcacaagcgcgaggaacacccaatggaaatataaattcgagacggaactcggactgatgcttgacacaaggaaggcgacgagcgcggctgtcaaaccttcaataagaagctttggccgtcttccaagcgatcttttataatatctgtaaagcacggttattaaataaatgtacatcgttaaataaccgagcatcatcaccactccaaaattcgtcatgatctcaacgagccagttatgaacctccacgacccggtccgtatcgaacagtgcatgatgctccaaataatatggcacattgccggcgccgacgccaaatccgtaagtatccagcacataatgcccggcgtttttcaacaaattcgccctggcgacattggatggcagcggctcgctgaaatcgtgtgcggtttgcggagccaaaaagtatgtataaaaagctccggtaatctttcctgcaaacagtgtgacaaaagcgatacatcctgcagctgcggcgatgagcgcccattttttaagcaccttcggcagcaaaatgaacacataaacggcaaggccggctatgacccccaggatgctggctcttgatccagtcaggaaaatcaagtatgccgaacagaacgcaaggagcagccccgctatttttaagtagctgtttttaatgtttttgaaaaaagataaataaaagaaaaagctgatggacagaaatgtcgcaaagtcattctggttgaaaaaaacggatgtcggatagtgctgtttatagtgcggcccgttataaagggtcgagctcggcaggtggtttaacgtaaagtgattgtaaaacccgatgaccattaaaaatacggtcatgacaagccatatgtaataaaacgcgagaatacgatccattttttgaaaaaacatgacaaccagaaaaacaaaaaacattcccattgccaataggaacagatattttatgccatcagtggcagacttgacccatagcagcgaaatcagtccatagcagaaccaaaacgcgaaaaacatcagaatgcctttgacatgcacctgcttccacttttcaaggtgctggctgcctttcaacatttccgctatgaataagaatcctgccagaatcagaagtattcgatatggaaacaggctgaaaaagcccaatttaatcgcaaaaaaagcattgttggcaaaagttgcagcgatgagcagatataatacgggcatcagcaattgctcggacgacaaatacttccggagcacaacgatcacagccagcgcaatcaaaattagacacgccagcaagattttttttgcattggactgggccaatacaacgaatgctaaccctgcggtcaatgcggcgagccaaaccagaacattgaccgcggaacgtttgagactcatttttccccctccttccgcttctttctggaaaagggctgccgacatcagccagcagccagtgatttacgtattcatttcttttttataatatgaaatggtcttttccagtccttcagcaagcggcatttttggttcccagtttaagattttctttgtttcttcattacacagtgtgctgtggcggatatcccccggccgttcatcttgataaatcggagaaagctcagagttcgtcgcttttttcatctctgtaaacagctcattgaccgtgatggaaaagccgtttgaaacatttaaacaaacgtttgattgagcttttagcgcctttacgttggcacaagctacatcaccgacataaataaaatcgcgtgattgttctccgtctccaaaaattaccggagccttgccgctggtcagcaaatcggagaaaatcgatacaacgccgccctctccttttgcatcctggcgcggcccgtacacgttgctgtaccgcaaaatgcaatactcggttccatatagatcataagccagttttaaatagttctccactgtaagcttcgtcagcccgtagggtgagcctgggtttgtttggtgacgggtgtcgacaggcaggtaatccggatttccataaacagccgctgatgatgcaaagacgatctttttcacattgcattcaccagctgctttaatgatatggagcgatcctctgatattgatgttttcatcatttaaaaaattgctgacagactccgctacgcttacttgtgcagctaaatgaacaatataatcgggatcaatgcttttgatgacgtcgatgacttccggcttcgtgatatcctgctcataaaagtcaattgggagaccgtcaatgttggagcggtgtcccgtagttaaattatcaagaattgaaacccggtaattttcttttagaagctgttcagcaatatgcgagccgataaatccgcatccgcctgtcactagtactttttccattgttatccccccgttgtttatacgttggtcaggattccttctccctgtacttccggccgtccgattgaatggtagatcatgccttcgtttctcatttgttcaatttcaaatatatttcttccatcgattaagacggggtttttcaaagcagacttaagtttggcaatatccatgttctgtacttccggccactccgtcaatatgacgcacgcatccgtatcctgaatcgtctcatacagatcttcgctgtaaacggcttgatcgccgagaagcttttctgcttcaggtacagcaatcggatcaaacgctttgactttagcaccgaggcttctcagcatcggaatgacatccagagacggcgccgagcgcatatcgttagtattcggcttgaatgccagcccaagaaccgaaatggtcatgccgtttaaatcgccgaacacatcaaggagcttttgcacaatgtgggcgcgctgcttttgattcgtctcgatgacagcttcaatcaatttaaaaggataaccgactgacttcgcgatttgcaataaagccatcgtgtctttagggaagcaagagccgccaaagccgattccggcttttaaaaatttactgccgattctgctgtcgagtccgacgccttcagacaccttggatacatcagctccgaccctttcgcaaatattcgcgatatcattaatgaacgagatctttgtagccaaaaatgcatttgcagcgtatttaatcatttctgcactttcaaggttagacttgacgattttcgtttgaaatggcttatgaagctcttcaataatggcagcagccttttcgcttgtcgcgccgatgactgctctttccatattcatcgtatcgtaaatagctgttccttcacgaaggaattccggattcgacacgacgtcgaaagggaattccccttttgaattgcgttctataatggcttgtacgagctttcctgttccaacagggacagtgcttttgttgacgatgactttatagccgttcaggtgcttcccgatcatttcggcaacggatttaacaaatgtcagatccgcttcccctgtttccgacatcggtgtaccgactgcaatataaataatctcagcttcttcaatcgcttttggaatatcagtagagaaaaataagcgattttcgtttacgtttttatccacaagttcttttaggccgttttcataaatcggcatcactccggctgagagtcctcttattttttcagcatcaatatcgcagcagacaaccgagtttcccacttcggcaaaacaagttccagacaccagcccgacatatcccgttccaatgacagcgattcttttcaacattatcattcccttctttcagctgacccttcaaatccaatagcttgatttaggtaatgatctttatctctttctattgaaaaaatctgggtttttcgttttcccaatccttatttttattagcttagacgcaaataaatgggtttaaacagtattatattcaacattcatacgcatattaaccgacagaccccaacttaatttttgttcttgacaacatccccatacacatccagcagctttccggcatttttaaaggcgtcataatcctcgtgcaccgtttgatacagctcttcagcgatggcttcttgccaattgccgccttccaaatatcccttgacagcttctgttatgctggaagccgagtgcggcttgatcagaaggtgttcatgctttccgaataaagacggaacccccccgaccgccgcacaaagcaccggaaccttgagagcgagcgcttcaatgacaacagtcggcatcccttcagaatacgaagggagcacaaacagatctgatgcagccagatattctgatatctcatggtttgcgacctgccccgtcaatactgctttttcaccggcgatttgacggatgttctgcttctccggtccgtcgccgatgaatacagctctgtagctgtcatcaagctgcctgaccgcttctgccagctcggctactccctttcccttcaccaagcggccgacgaacgtcagcaactttttgtcttgcggcaggccgagtttctccctcaattcaagtgttgaagcggagggcttttgaaaccggtccaggttgactccaataggaagcaccgagctttcagcaccggtcatttctttcgttttggctttcagcgcttcgctgacagccaatacttttgctgcggaatgcacagctgtttcaaatgctcgaaaagcgcctttgctgtaatggggataaatattgacatcgcttccgtgcaaagtcagaacataaggaaccttcagcttctgtgaaacaacggcagcggcacccccggatggcatcgcgaaatgggcatggataagatccggcgcaagcccgtgcttctcgatcgtcctcaatacagactttgcgatccggcgatgcggctgagcccattttagctgtccaggcaaagccgtatacggcggcctgtaaaccgggatgccttttctttcttcatattccgggactgttcgcacttgacggtatttttttttcagcagcctgagaggagcaggattcacaggcaatggacatatgaccgtcacatcaacgccctgcatctgcagcgcctgaacctgtgtttcatgaaaaacgccttctcccggcctttgactgcttggataaacgctggtaatccaaagaaccttcaatgatgaaccgccctttctgctgtcatcttcctaattgggccctcatagcccgccgataaaatttgccgaccagaaaaccgtaaaaaatcccgctgatcccgacggaaactgccagctgaagcatggcgccgtgaagcagatgtctgctgccgacgctcaagacaagagccagcaatgccatgagcagcgtcaaggccagcggttttccaacggttctgaaatattcgcccagcttcagctggatgacatatttgagcagccatctgccgataaagaaattgaccaggctgatcgctgcatatgtccaggcggtgatcgtcaaatcattcgttaataccgccgcgtaaagagacagcccataaaggagcatgatcccgctgtcccaataaaatgccaggtctgctcgccccttcgccagcaaaaccgatccgttcggattcatcagaaccctgagcagcccgacaatcgcgaggatgttcagaaccggtacggcctgcagccatttttctccgaagacgacttcaacaaataaatctgaaacagtcgtcagtccgatcaggagcgggaatgaaatcagcgcgagaagctttgtcatatttaaaaagccttcgcgcagcgtttggttgtccccttgattctttgagaagacaggaaacgctacccttgttacgatcggattgatttttaatacgggaatcgtaataatctgatacgccaggttatagattcccaatgcttccgcaccgagaaaccgcccgattaaaatcatgtcgatattggcgccaagcctgtttacaagccttgaagcaagctgaaacgcgccgaacgagaaaaattctttcacttcccccaatgcaaagacgaaagaaggacgccatttttttaaatatacagcaaaaaacatgatgcctttaaccgaattaagaaaaacttgtgacaatgcataggccacaatcggatccatcagaaaaaccaaaacgagcaggagcacaaaagacaaaacggtgactcccgcttctattttgctcagcacattaaacttcagatctttttgcagcatatattgatactgctggccgaccggggcgattaaaaacatgacggccaaaatccgcactagaaaaacaagttcgtcccgctgataaaagtctgcgatgaacggactcaggaaaaagaggccgataaacaaaaggatgcccgttaggatattcagccaatacaaggtcgataattggcgttcactgatgttctccttttgaattaaagcggccccgaatcccatatcgagtacaatttgtgtgaaaatcgttacggtggtcagcattccgaccaaaccgaattcggcaattgtcatgatattgccgagcagtgcaaactgtataatttgaatgaccgtgacgatcaaagttgaaacacttgtccattttgcaccgcttaatatttgtttcgtaatggtagacatagcatattcctaacttcctcgtattatctggctccttcgccagtcaatactactttaatcgttttcagcataaccttcaaatcgagaagaaacgttaaattccgaatgtaatacagatcgtgcaccaatttttctctcggactgatatcatagcctccgttcacctgcgcaagtcccgttaaacccggcttaacgattaagcggtttttaaatcccggaatttcgtggtgaaactgagcggtaaacatcggtctttcaggccttggccccacaatgctcatgtctccggccagcacattgatcaactgcggaagttcatcgattcttgttcttcttataaaagacccgactgcagtgatgcgcggatcatccttctgagcccatttcgcaccggatttttctgcgtcaattctcatagaacgcagcttgatcaccttgaaatgcttcccgtcttttccgacgcgttcctgccggtataacggagaacccggtgtttcgatacagattaatatacaaaacagcagaataaacggcagtgtaagagcgagcccaatcaaggaaaggacgatatccattatccgtttcatatataaataacgtactgcttttttagatagagcacaggaataagtttgctggcttgaatattcattgtacattcttaaacttttgtcgatactcactagcatacacctcgattagtatgttactgtttgatctattcgtcagtgtagcatacgaacgtaaacacaatgtaaaggagttattaaaattagtaaattcgttgattttttgttaaaaatgcaccgcctccgttttatctttaatttcaccaaaaatatcatactatataataaagacaaaacaaaggcagcataggcaatttttcgaaaaacgagttttctgtttatattttaatagtaagcaacgattccgtcgtaaatcgctttagcgcctttttctttgtaagtcgagcttttgagttttgtcgcatcgcttacattgctgataaacgcaagttcaacaaggcagcttggcatttttgattccctgatgacatggaagttgccgatctttacaccgcggttttttgtattcaatgcaacatagagacggttttgaatctcggttgccagccgtttgctgttggcagattcatatgttgtataatagtaggtttctgttccggaagcagctggcgttgccgagtttgcatggatgctgacaaacaaatccgcatgatttgactgcgcttttgacacgcgctgtgcgagcgtcaggtaagtgtcgttcgttctcgccataattggcagagcaccgccgtttgatagtttcgtattaattaattttgcaacatcaaggttcacgcttttctcatataaaccgttgccgacggcaccgctgtctgtacctccgtgccctgcatcaatgaagatttttttgccgacgatcggattcttcagctgtgacacgacattggattgaagagaaaccgttccgccaagcacagtaaacgtcgtcatgtttttggaaccgatcacttctcttgtcggtgtcggcaaagatgatgcattcgtgaacatcatcggacggttttgcttagccgccagaacagatcctgttaatccgtcggcatacgcatagccgttgctgatgattgcattcttggcagaagaataatatttcttgacgacattggccgcgacttcatagcggttgctgccgccgatccgcgtcggagaagcaagctgtttgtaaacgctgctggagatgctgacttcaccgcctacgacaatggtcgatgttgttcctttgctcttcatcgcattttttgtcgctgtcggtatggaattcgacgatgttaaaagaatcgggatgccgtttctcgcggcatatgcgccgatcgcaaggctgtcagcataggccgtcccgtttgcgatgacagctttcgaattgctcggcagcttattcgcaatattcgccgcaacctcgtagcgattcgctccgccgatgcgttcgacagatgacacaccaagctttttgatctcgcttacgacaccgttttgaacgctgacggttccgccgattacgatcactttgctaggttttaattgactgattcggtttttagtggccgttggcagtttagacgcttccgttaatagaacaggcgcgttgtttcgataggcaaatggagtcgctgaaaggacgtctgcatatgcctttccatttgcaacaatcacagtgcttgcacttgtccacccctgcttggaaacgttcaccgcaacctcatatcggtttgcaccgtctaatcttgtgacagagttggccgcaaatacattaggcacaaacaaaaagaaccctaacaacaacataggtacagctttaagaaaaaccctcaaaaaaataacctccaaaaatgtaaatgttatgttttcccctgaacatgaacagaggaggcactgctgcctcctgttcaaactctattaatagcttgatagagtcgtatttggatagtagaaacttaaaatcttcttgtaatcgtgcccggcagcagctctggcatttgctccgtactgactcatgccgatgccgtgtccgaatcctttaccgctgagagtaaaagcgttcgtattgctggatacagaagcatacgtgctcttcatattcatgccgcccagcatcgatcttaattgagtcgtcgtcacggaaatcgtcgctgttttttctgaaagttttccgtttgatagaacatagccatttgatttttctttaacaaagtaagaaaacttcacctctgctgttttcggccgctgaccggcagtttttgcgctgctcagggtcaggcttgagattttcgtaatcttaatagattctgcactaggatatttattggtaataaaccagcttttcagtccagacaaataggcggagttcgtttcatttgtcgtattccaccatgtgccagggctgctcaggtttaagccgctggtattgatctgcgtcctattcaaggaaatcgaccagctgttttgcgggtcatatgtatccgctttggcaattaaatatggcacactaccgccccatacctctgcgcttgcttccgtatatcccccgttgcttgacgagtaaacggctgaaatcaaattgccgttatattttaaaacttgtccttttgtggcatttacaacgctggatgtcttcgaattccagtcgtatcctccgtatacttgaaacgcctgcgtatcggccactacttttcctgcggaaccgaccgaataagttctcgccgccaccgcttgggcttttaacgcttccgtctgccagcttgccggcatttcgtgcggcacaacaccttttaaataatcttcgaacggaatgttttcgtttatcggccgaacatatttgcttgattcaatcgtaaacttcatcttgcctaaataaggccttccgttgatgctgatggaatttgacgtcgaatattttttaggtgatgccgtaaacgacgttccaagcgttttgacggctctattatttttatagagcacaagctttccgctcgacacgttaacagagtatccgtctccggtaaacatatctgccaggctatttttcaatgaatccgtgatcgaggtggtccccccaagcaaagcaaaagactgtgttccttttttcgcgactacatctgcaacaggtgtcggcaggctgcccgcttggacaagcagcaaaggatgcttttgtttggcagcaaggacggaaccggccagcgcatccgcaaaagtcgttccattagacatgaaaacctttgatgcgttcatgttaagcgtgttgacaatgttcgctgacacttcgtatctgttcgctccgccgatgcgggtaacagccgcttttttctttaatgtgttttcaacgcctgtgctgacactcaacggaccgccgacgatcgtaaccttgctcggaatattgtaatcgcttcggattgtattattccctgagagcagtatcggataaccgttcattgccgcataaggcgcgatagacagagcgtcggaaaagactaagccggtggcaacaatcgcttggctgtaggaccccatccggctcgcgatgtttttggacacatcatagcggttggcgccgccgatgcggtcaattgccccatactttttcagcgtgttttcaacatttttggaaacgctcgttgttcccccgataattaagatattatcaggcttcatcttggcaatttgagtttcggttttcgccgtcagcgtacccgcatccgttaatagaatcggcgcatcgtacttctttgcaagcggagttgcagaaagcgcgtccgcaaaagcgtcccgattgacaaccacgacagtgctcgggttcgtccatccggcagatgcgacattgtttgccacatcgaagcgggtcgccccgccgtaccgctctgtcgcggcgattcccgagcccgggatttcgtatgcgccggtaatgtcgacatcaacgcttgatttattgcccaaataattgcttaactttaccgaaatggttttgtcggcagcctgggcagattgtgtaaacatcagagctgcggcagttactgacgacagaagcagaagcttcatctttttcaaaacgttatgtacccccttgattcagctctttattttgtttcgatgcttttcagctccaaaacgccattttcaccttttgtatattggacttcgacttttttgccttcttcaatggaattgactttgtcctgaagatcttcatcgacttgaagcgttgtttctttgccgtcaatgttcaccgcaattgtgtggctgtcagccaaccccgcgaatgaaccttctttagtgacggtttcttcagaggccgcatttttattgtctgagcttgacttgtcctccgattggcccgaagtgccgcaggctgacaacaaaagcagcattgataatgttagaactatgagttttttcatcttcttcacctctccctttttatcgacaaattccaacagattctttaattatagcgaaaaattttgcagattgattggtttttttgaaacatttttctaatgatttcgtctatccaaaaggacacatataagtttttgttgttttcgaattgtgagaaacttataatcaaagtagactatataaaaggtgagggctatatgagagctgaaaagagaaagaaaaagaaaaaaattctatataccattatcgctttgcttggaatttttgtcctctgcacaggcagttatgcctattatttatggaataaagcggcatctactgtggcgagtattcatgaaaatattaacaagtcaaaaaaacgcgattcagaagttgatattgataaccatgacccgttttccgtgcttctcatgggtgtcgatgaacgggacggtgataaggggcgcgcagactccctcatttatatgacggtgaatccgaaaacgaaaacgactgaaatggtcagcatcccgcgggatacgtatactgaaattatcggtaaaggcaaattggataaaatcaaccattcatacgcattcggcggtgttcaaatgacggttgacacggttgagaactttctcgacgttccagtcgattattttgttaaagtgaacatggaaagtttcagggatgtcgtagatacgcttggcggcattaccgtgaacagtacgttcgctttcaaatatgacggctattcattcggcaaaggcgagattacgctgaatggaaaagaagcgctcgcttatacgagaatgaggaaagaggacccgaacggcgatttcgggcgccagaacagacagcgtcaggttatcgaaggaatcattaataaaggcgccaatatatcatccattacgaaattcggagatatgttcaaagtaatcgaaaacaacgttaaaacgaatctcacgtttgacgatatgtgggatattcaatccggctataaggaagcccgctcaaaagtcattcagcatgagctgaaaggcgacggcacaaaaatcaacggaatctattattacaaagccgatgaaagttccctgtccgacattaccgccgaattgaaagaaagccttaataaataaaaaaagcttcctgaaaaggaagctttttttattaatctttaaacatgtcaggcctcgcgcttcggtatccgtaccggtaaagaagcgcctccgcaattcgccgcgaagcctgtccgtccccgtacgggtttgaagcccgggacattttgcgatattcatcttgatcggtcaacagctgtttagtcagctgatagatcttatcttcttccgtgcctgccagtttaagcgtcccggcctgaacgccttcagggcgttccgtcgtatcgcgaagcacgaggaccggctttccgagcgacggcgcttcttcctgcacccctcccgagtcggtgaggatgaagtgagcttcagccgcaaagttgtgaaaatcgatgacttcgagcggctctatcagatggactttatccaaatcgccgaaatgctttgcagccgcttcgcgaacagcgggattgagatgaacgggataaacaacctgtacgccgtcaaattcttcgatgatccgcctgatcgctttaaacatgttttccatcggctcccctaaattttcacggcggtgggcggtaagcaaaatcatcttgtcattcccgattttttcaagaacgggatgtgaatagccgtccctcactgttgtgcgaagtgcatcaattgcggtatttcccgtgacgaaaatcgtctccgggtctttattttcgcggagcagattctgttcggcctgctctgtcggcgcaaaatgaagatcggcaatcgatcccgtcagctgcctgttcagctcttcgggaaacggcgagtatttgtttccggttctgagccccgcctctacatggccgacggaaatttggtgataataagcggcaagacctcccgcgaatgtcgttgtcgtatcaccgtgaacaagcacaatgtccggtttgatggactgaaacagctcgtccagcttcacaagcgcattagacgtaatttcagccagcgtttgcctttctttcatgatattcaaatcaaaatcaggctttatgttaaaagcttcaagcacctggtcaagcatttgcctgtgctgggctgtaaccgtcacataagactcaatgtcggggtatttccttaattcaaggacgagcggcgccatcttaatggcttcagggcgcgtgccgaatactgtcatgacttttagtttcttcatttttctatcacctgttttctgtatgaacagcttttttacaaagaaagctttgcctatatttttctcgcaggagccagatttctttttaatacgtttgttatctcatcataaaacatatatttataaaaccgcaaacctaccgatggataatgagaattctctttattatacaacatctttatgctttatacctgtttacacttgtttaagaattgtttttcttatatgatgagtttgtaattgtaattttccggggtatatcatacatatattctgcatactctccgcttgctaaagcgcatttttttctcgctgagtagaaaacatagtttaaggaaggtgtattgaattgaagaaagttcgtaaagccataattcccgcagcaggccttggaacacgtttcctccctgcaacaaaagcgatgcctaaagaaatgcttccaatcgttgataagccaaccatacaatatattattgaagaagctgtcgaagccggcattgaagatattatcatcgtaacaggtaaaagcaaacgagcgattgaagatcatttcgatttctcgccggaactcgaacgaaaccttgaagagaagggtaaaaccgaactgcttgaaaaagtaaaaaaagcgtcaaatctcgctgatatccactatattcgccaaaaggaaccaaaaggactcggtcatgccgtttggtgcgcccgaaactttatcggggacgagccgttcgcagtgctccttggagacgatattgttcaagcagaaaaacctggtcttcgccagctgatggacgagtacgaaaaaactctctcatccgttatcggtgttcagcaagtccctgaagatcaaacacaccgctatgggatcattgatcctctgacaaacgaaggacgtctataccaggtcaaaaactttgttgaaaaaccaaaaccgggcacggcaccgtctaaccttgcgattttgggacggtatgtctttactcctgaaattttcatgtatttagataaacagcaagtcggcgcgggcggagaaatccagctgacagatgcgattcagaagttaaacgaaatccagcgcgtattcgcttatgactttgaaggcaaacgctatgacgtcggagaaaaactcggctttatccagacaactctcgaatttgccatgcaggacagcgaactgaaggattctctaattccatttatccaagaccttttagcaaaggaagaaatataaaattccaaaataaaactggcagggattggatcgctgccagtttttttattagtgtacagaagcaacactcagactatgctcattattatcgataataaacagttgagtttttgtcctaattatataccggttcttgctcttatctaaaattacttgatcatcttttagcattaaagacttgggagaaactttctgaatatcgtgaaatataactgtagttgccttttgattttctaaaacataacttacattttcatacctaagataatagccgttccttccatcctcaaagttttttttcgttaccccttttaaaccttcctttaatactgtctcgtctttccctagaaaagagagtaaatactcataagaagcttgagcattttcattgaaatacggcttaaaagcgtttactaataggttagcttttgatttttcattccccagagtaacaccatttttagtaacaaagtaatttttttgattgaaattgatttttgcaacttttttattttgagaaataagggtcacttttgttccaaattttaaagaaaccttagttttgtgtttcgcttctttatcactatatgtttgaaggtcttcagttaacacatatccagtttgatttaccttcgtaaaacggcttgttttttgctcttgatgttgttctgttttctttgcttcatttcccggaatagcgccaaaagaagcaattgttcgcaaaggagtgctgataaacatcgttgctgctattgcaacaagcaatacagacagtatagatatctgtatagcattagcaacagtttctgacttcttctcctttttagaaaaacgagttgttttctcctctttttgtttaagcattctttctttgacatgttcaatttggtattttttcttttcctttttagacaacttattgaaccaatcaacaaaagctttatattcttttacaacttttttggtttcaccgaacatgcgcatttcgccatagtgcatccatgcaacacggtcacacattttctcaatttgactaattgaatggcttacaaagaaaattgtttttccacgctctttaaattcattaattctgtcgacacatttttgatagaatgtctggtcaccgacagacagtgcttcatcaattattaaaatgtcaggatcgatgtgagctgatatcgcaaaaccgaggcgcgatttcatcccgcttgaatagcttttaacaggctgattgataaaatccccgatatcagcaaactcgacaattttatcataaagctcatcaatctccttgttggtcagccccatcatcaaacatttaagccggatgttgtccttcccgctcaactggttgttcaatccagccgaaattgcaatcagggagggctgtccattcatctcgatttcacctgtagtcggaggaataactttggcaagcaaattcgacatcgtcgatttaccagaaccgtttatcccgacaaaaccgatggtttccccctcataaacatcaaaagagacatttcgcacagcaaaaaaccctttatcacttttattaggcaggaacagcgcttttaccttatcagattgtttctcataaagctgatactgttttgaaacatttcgaaacgaaacttttagtttcatcgtatattctccttactttattaaagaaaatcaacaaacttgtccctgaatttcatatgcaagatggaccccaccgtcaacagcagtaatgtgaatacccagaaatacaaagtatattttacatcttggaaaaaccaatcaccatttaaaaagctgtttctaaaaccatcaataatatagtaaagcggatttaatttaataattgttaccacatacggcttgtttgccaaactgtgtgccacatcccaaaagatcggcaggagaaaaaacaaaagtcttgtccctgcttgaagcaaaaactgataatcccttactaatacactgattgttgaattcaacagactgaatgaaaacataaatgcaatcatacagaacagatagtaaaaatattgcagccaatgcaacgtgggaaaaaatccactacccatcagaatcaggacatagatcaacgtcatcccaaagtaactgaataaatttgaagcaattacaaccgccggcagtgagctgaccggaaaattcattttagacactaaattaattcttttatatacactgtttgatccatcaagtatcgttgggctaataaaaaaccaaggaatgatgcccgcaagcatccaaataataaacggatagtgttcgacatctgctctagcgcctctaattcctgctccaaaaacaaaccaataggctaaaatttggatcagcgggtttagaaactgccaaacaacacccaaatagttcatttgatacgttgactttgtttcataaaccgcaagccgcataatgagcggaagcgaagaaaatacctctttcaaaacttttatcattgcattcattggttatcttccttaaactaatttgatttggggtttttttgctaaagaaatttaaagtaccgcagtttattgtaacagatgttgaaaattttttcacatcaaaacaaagttaagaaccttcatttagcattttggaaccaactctccgcgatccaaatacgaaaaaggctaagttaccccttagccttttctttaagtatgcctgaaaaacgttaatttgaaatcgtttcaaaaagttttttccagtctttcaataatctctcttcactaaacttctcagttattttagcggcttcaactgacattctttctctcttttcaccgtcatttaatagctcaataattacatccgctagctgatcaatgtttcctctatctacaattttcccatcaacatcatttgaaataacatctctaggaccatacttgaaattgtaggaaactggaacacatccagcagacatactttccattaaggagagacatatcccttcataatcagaagttactaaagagagtgctgattcaaaaaatacgttataaacatcaacagaaaagccttttaacaatacattattctctaaaccgagctccttgattaagttttttaaattttgctcctcagaaccccgcccataaaattctagttttgcatccggtattttatcaacaacttttttaaatgcttttatggcatgatcctgatttttcatcttctcatatcttgccacaaaaaccacagtacgagaatctcgttgagtatctttggcaattacctttggggcatggtgcggtatcgcaaaaaacttgtcacttgcaccaaattgtgaaattatatcattcttttgttcttctgttaaaaacacaactgcactataatcgtgaatatgattaaagaagtcaatttgttcttttcttatcggactgccaatggtatatggtgcagcaaagtgattgctgtggaatgtataaataacctttaagttttgcaacttactttcaatactctgcaactggactcgattaaaaccatattcagatattaagaacatttttttctcttcagttaatacataatttaatagccaataagctaacatctctttttcattattaaacttcgccttgaagctgccgttttcatcaaagtaaataatttggtttgttttgttagtttttgggttttttgaaaaactcaaatagcaatttccttttttgttaaaaagcagaaccctggatggtgtatttgtttgataatccatatactctacttttcttacgtatcccttcgaatcaaaccattcacgtttctccctgataaagttaggcaataagtgatcaataaacaataaatgcccttcttcttccgaataccatttgaattttaaataaagtccatccttatagcatctataaacattcttcttaacctcgtcctgaaccgcaaccgatccatcctgttcaggagaatggacgattccgactctctcatctctctgtgtatcattagcgagttcattatatagataacgaactgtagtgttgggctcgagttgattattatcttctagggaattaatacattcatcatagttaatgtaccattcgtgtattaatatatcatttttaatattactttttgatagaacattacttcttcttaatactgaggttgctaagcctgtaggttttgctggcaaaccgccaaacatgagcatgtaaactttatagtccatggttatccactccaattttaggttccactaatactggtgatgagttctcgatttctctaaaaagttttcgccatttttttccgatgttttttgtagagtatctatctacatttataattgcttgattccccatcttttttcttttttccggattctcaattaaaaagtttagagaatgagcaaattgatcaacatcaccgttatctactaatatgccatcttcattcattctgattatctcagatggccctttaggacagtcaaagcttacgaccggtaccccacactgcatcgcttcaactataaccatgccaaacccttcgaaacgggaactgagagcatagattgaggatttcatcaattcattttgaatattatcagtcggtcccattaagtaaacatgattataaagatcttcttctataatgaggttattcaaattttctttttcctgaccaataccaaagattttcaaattccattccggatgttttgcaacaacttgcttaaaagaatgaattaatagatcaaaccccttttgttcaacaagtcgccctgcagctataaccgttttggattctaatgaagattgcattggatctatatcaggaatagaattcgtaacttttctaattctgagttttgttcctttaaacaacttcacataatcgtgtgtatcatcatctgtaagtgttaataaataatttaaacgagggtagtatttgagaatcgaccgttgcattctgcttgagtaaactgaaaaattcaaatgctcttgtccaactaatataaccccttttggcgcatgtttagctgcaaataaattaaagcttggcctcgttgtaatcaaaattccttcctttattgatttaataaacgtataaagttttatatctgataataaagaaaagaaatgccgagcttcttcgtccggatgaatcattttagattctttatttaaaagataattacccatccttgctttaaaactctttccttttttatcccatgttgtcatatcgtgcagtacagttatttttatacggggatctatataaaagaactctttcttttgcctcttaaatagagaaataatttcgactggctctccttgatcaaccagataatttgctgtattcaagactgttcttacagttccgcccattccaaagacattcataaccaaaaaatattttttcattatctcaccctaaaatatacgatcaattattttttttgatgcaagcccatcatcgaattcacaatacttattataaaaatctttgtacagatttttatacagaaaactaatctgttttatattatttattgacttaaataaatccacttcattagtaacaatcggaccaggagcctctttcctaaaattaaaataaaagcctcttagagcagaagaatatttatttatatcataagcaaaaaatataattggttttccggaattagcaaaatcaaacatgacagaagaataatcggttacaagaatatcagtaattaaataaagatacttaatatcatcatagtttgaaacattataaatcagtccttcatatttgcttatttgagcacgaactgcatcccggtaatgaagccgcactagtagcacatattcttcaccgaacttttcaataaagtggtctaaattaaatttaaattgaaatggttcatgttgttttttattgtggaaatcgtcatctctccaggtcggcgcataaaggataacttttttatttctcggaatccccaactcttcttttacagaatttgcgatcttttctttattggacacataaaaaatatcatttctaggataccctgtttccaatatatctttcttaaaagcaaaagcactcctatacacagatgaagtaaaagtatttggcgaaacagtaaagtcccatctactatttcttctaataagagcaggtgatgtattttctttatatgaaggtgaattcgggctaatatcgtatcctaacttttttagtggtgttccatgccatgtttggatatgaacagtccctttacgctttcgataaaaatcaggaaagttaccattgttaacaaaatattttgctttcgccatgtaataaaaatactttagtgaattaggttttacgataacagtgttactgttttctgttaactttttgtttatattatttaaaacccacacgtacttatattgttggccccgtgttctcactaactcctcataaattgccctaggattgcatgaatagcttttcccatggaaactttgaaacacaatgattttattattaataggaagacttttattaaaaattctataaaccacattataatttttaaataataatctattaataatgttattatttagttttgctctatcttcaaatgaaaatacgcctttttgggcatctatattaagctggagagaaataaatttgttatcatcaatatgaaccttcaatatggctaaatcaaaattaatatctcgtattagatcatttaaaacatcacgatttaagaagctgctaatgaattcgaacgaatattccaaaatggtattggatgttttctccaagttaattgttcccgggacagttattttttctgttttatttggaatccgaaaatagataacggacgaaaattcacctgttaaggtttttgccatttccccatttgaaggatttacattaagaaggccgtttaatataaaagagtctttttcaattctgtaatgttgaatttttttctgagctgccactttacgaattaataaagataaatcattgtttaatgtataataaggcttaacagaaaaaagttcgtttaaactattttccatagtgtattgtggtaattgaacaattttttgtttatgttcgatgtcatccaatacctttgatacacgataactattgtaatttgtttcaatataaatatcccatattcccaggcctagttctgcatccttcaacagattagctaaattgatcttaatgatatttgtctttatcggaattttcaccactgaaaaatctgatctatttctaaaaagtacagatgaaacttcctcacctatcgatttatttaatacttctccattgatggttagattttcatctttaaaatagacttcattcaattcataatgactttctatattcttgatatataattcaaatgtcatttcggttttacgatttaccgagtgaaaagagatggaatgatggttaataaaaatgctatccttcggaagcacacttttgtttttaatgtagagagagcttgtatattcttctcctttatatcttgtttttatatatacagataatttagaggatttaaatagagacaagacatcccgaagattaatctctttttcaaaaaagatttgaccatttgctcttattaaatccaaacttttttctaaaacttgatggtctttagattccaatataaaggaaactccctcgacctcttctaaatccttaatatcaattcccccggctacacctcttattaaaagtgctccattttcattgatatgaatttttttcagcatataaaatggttctagtgatgtcacacgaatagataggtttcctttaaccgtcgaataaagaataatatttcgtccgagttcttttattgacgatgatctcatctccatttttgctgttaaaccatcatatactcgatatttattatccgattcattatttaaaatataggcatcccaaagccctacttgcccaaaaacgcttttatcaatggtgtattgaattgaaatttctgtattggatgctactgcctcatcagggtttattaagatttcttcttgcgtagacctatttttcaataaaaaaagtaaattatagtaatcagaaacatccacagtatcattcattttcacattcaatttaattacttcatcaaaaaatgtaattgaaagcagtgaactcatccgactacctttgggtttccacaactttttaaggagcaaaattttcacctcagaccttagctattaattgaaataattatttgatcacgagtttgctgtagcgaaacagaataagtttgataatcaaattgacatgaagactgattttgataaccaaaaagtttaaccggaaagtctatatgattatcaaatgcattatatgttcgaataaacaaacgccatctcgaatttcgttccatacatcttaaaaactcatcatctaatttaaattggaatataccatctattactttcccaatcagagaatgatatacatttggtttattaagagactttaatataaaaaatgttttatttacaaaataatccaactcactttcgctgcttataattgctccctccaaatttaatgaatcttcagatttgtttatttcagaaagataaacttccgtttcaaagggttggaatataaatgccagagtattatatattgtggaaaatggtttgaatttatataaagttttgttgtcatattgataatcttcattgaaatcttttcgcatcagctttattggatagtctttaacttgtccgttatcctctaaccttaaaaaaagatcatatacctcactaggggacatagctttttttaaaatctctttcaaattggtttgaaagagtaggttgttgtttacttcatctatttctatgtcgtatagatgctcatgtacatattggccgtatttattagactttgaacgttttttaatggagagaatagggttaatgcctttcaagtcgatttctccacagacctcaatttcaaccgtaaacaacttttcagaaaaagttgtgttgactgcattaaccacaatgtcattgtttcgtatcgaaaaagttaaaactttatcctcgctgcatcctacctctaacctgcttaattcattatttttaaatttataactctgaggagacaggtcagtcccgcaatatacaggcgtttgttctcccgtattcgaattaaaaataaacatctcataatcgccttcttcatataaataaagcgattctaaatctattagtatttctccctgcttgttctcatatttctgaagagataagcttttcgtttgatctaattgattgacaattctaaccgtgaattcaggttgattttttaaattcaaattaaaaaagttcatacttatatgctttacatcatcaataaccaatattacttatcccccaatacccgatataaactatttttttcgctaaactaaataattatccaaacgctctccacaaaaaacaacaaaaaatgaagtaacagctatcacttctatatgaagaatttcaatattctaattaaacaaaataatctaaaataaaattaaaaaacaatccaaaaaattctgtggtaatcaaatattcctttactaataccaattcaacatttttttttacagtgtttaataatgtcttatgatatcataaaagaagctgaaagttaagatctttaggaggttgattttcaaaaaaacatgtctaacggtcgagtttttgattcacaagggggttataaactcctatttaaatcaaaagtgcgaaaaacacaccttaaacagcacgaatgatctattgacaacacaaagaaaaaagaaggcgggagctgtttcaaagataaaaataatgccttttggacaaaaaaaatcctgatcttttataacttagtgaccgcatataaaataggcactatgtcattaatcgttcaaccaagacaattcttaaatactattagtccccttatttctctagacattttttcgatctatttccaaagaactgcaccttagacattcaacaaaaatcatctgttaggctacaaagtgttttttccatgctgccagcgaactcagtaaacaccttacaatgatatgacttgctgccgtccaaatgccacatgtaatttaaccgattccacttaggatcgctttatatccttcttcaacaagttttattcgtaaccgaaacgacttctgattatagagaaatatctatctgaacgtcttacggttttcgcggctgagtcattctcttgaaaattgaataaagccaagttctaaatgtttctcaatttcttgaatgatttcttaaagcacagagccaacagattcaagctgtactcaagtcgtctgcaaaaaattaaaagacgatggacaacttcaagctaaaacaaggaaatattaactgccatattacgattgactagctgaaacttgttattttcttttttttgtttagaataaaaagaaggtattagtacaaaagaccaaacagaaacagacttttaaattagccgataaacttttaaggagttgccaacagtgtacaaatcatgcgatcaagataaaaaaactattgtttcctttacaatggtaaagaacgaagctgatattatagaagtatttattagatacaatttaaagtttctcgatcatatgttcatttcaattaatcgtccgaatgatgaaacgagaacaatattacaaaatcttttaaatgaagggttgcctataacactatgggaagacgatgatccgtcatttgaacaaaataaaaagaccactgaagcataccataaaatttccaaggaatttagtttcgatgcaataatttttttagacgccgatgagtttatatatggagatataaccgaactcaaagaaaatatcaaacagggtaatatatatcaaatggataggcttgagtacgcttatttagaagacctttcgtttaacgaaaacgttttagagaagatacagtataggagaaaaaaatatcaatctgcaaagtctctaatttgccatgacaaaacagattatgaaaattacaaaataggaaatggaaaccattacgtttattacaagggaaagaaaaaaataaatgataagttaaacctaaaattggctcatttcccttatagatcaaccaatcaatttattaataaaaatatttttgaattggctctctctaatgtttaacaatcctgccctgttgcatgctgaaaaaaccattggtgtccattggagaaattcttataaatatctgttagatagaaatttaaatctgtcatccaatgatttattctcgtatctttataaaacaagtgataaagaaagctttaaagaggaactgatatttgaacccttaaacacaaaagatattcatttaagatacactacccaaaaaaatgaaaagtcattacaatatatgctagtcaaggatttcgagtcagctttaaataaaatatacgaattgaggagtacacagcttaactctttacctaacaatgcagctcaaccccaatctaccacttatgatagtggctttaactatagcgaagtcaaattattaaacaatgcaaaggtttatgcccaagacacccttccccgaattagaaaaataggaaatgaagtagaactatcgggagctattaaagggatctctaaagggaagtcaggtgaatatattgaattcccaaaagagctggcaccggatcgaaactttcaatacaccaatgtttcttcacatggcagtttagcatactggcaggtacaacccaatggtcggctgaaattattaagagtcacaaatcagaacgctgatgatttatcctggtatccttttcatattcgttggtttgtttgaaattgatcaggaaataaaaattcccctttaaaaacactaacagtgtacttaaaggggaatttttttatatggaaatttgataagcattgtcaatgtgaaagatgaagttatgttgtcctctagatttcaataagttaaggacgcaaaacagacatatatcaacttgcagtcctttaatcttccatgaaatcataattaaacgaccttaacccgaaaggaaaaacggactaaggtcgtgaagaagtgtttttaattgtaatggcattaaattcacaaattaaacaggtattacttaaacttgctcagaacaaacttctttataaaacattttcattgcttgttgattgtaatcttcgtagttaaatctcttgaatcttctattataatttaaatctttatttaatgtactaccctcgtcttccgagttgtctaagacgaacttttccatctcagaaaaaagcccatctaaattatttggagcaagcgttccatacccatcttctaaaatacttctagaacctgcaatgtctgtagcaattatgggtttatttagtacaagcgtttctaacaacaccattggctgtccttcatgattagaagataaaacaaaacaatcagctttattaattaggaagaatggatttttcatttgtccagtgaatataacactgtctgctactcctagtgtttcaactagatcactcaaagtctcctttaaaataccgtcacctataatataaagcttcattttcaaacttttatatttattgatcagttgagagaatgctttaattaacttctcttgatctttttcaggtgatagccttcccatgtttacaaaattgatttcgttatgtttaggaagcctaatccctttcatactaaatattcctggcttttcttccttttggataatatgatcttggccctcatagctctcgatagaaaaaccatgattttctacagaatctataatcttttccacatttaaagagttatgaacgtaaaccatcttattcgcatcaacataatgtgctaaattttcagcatttaaatctctagtatgctttgctacagaaacgattttattaaaacacttatatagagaaaagactatacctaacttacgtttgtgtttatattttccattaatgattttttcagtctcagctagcatatcattatgttggtatatactctttttagaaaaatcccctagagccataaccattgtccagaaaggtacgtatccactaaaatcgattgctatatcgaccttaacattacccaacatacgatttatttctctccgaaaaatcttttcagggtttcttttcgctagttcctcagtgtatccccttctgttcatcaatccatgtaaataccattcttttatggttaagttcatacttcctactcgatatacccgctttgcctttgcatttatcctgcttatattgtaagaagattctttatcatagtttcctttatcaattacaaccacattatacttgtcgtaatctatattgtttaacaagtttatagccgaggatgttataccattattcaggaaaccgccacagtaaatcaaaatggtttttttgtgaggctctttaacatcaaagacacagtcagactgttcttgtttgcctttaaatataatatcaactaccttttgagtagcatctcccactcttttgatgtaaatctcattcatttcttgatatacagactgatattgttcttgtatagactcaatatccttaatacattttgcaagctcatcagttgttttacatattgggccagctagtgtattaacgtccaagtacattcctctttttttcagatactgctctttatcatacataaaatacagaattggtttgttggttgccatataatcaaagaaaatacttgaataatctgttatcaggatatctacaagtgataataactcatttgtatctatacaatctggaatacatttattcattaattgttcatcatgttcaatatatttaaataaaagggtatgcacctttaatacgagctgataatcgtctggaatcttttcattcaattccgaaatatgattgaatagctcttcattaatgttggaaacacttcctacttctcccctccaggtaggtgcatacaagataacctttttattaggatcaagttctataaagttttctaaagtttttctaagttcttctttatctgtattaaaggtcaaatccatcctcggataaccttcctcaataatttccccattataaatacctgctaagtcgtgggaatcaattaatttctccgaagtgaattgatttggagacaagatatagtcgctatgcaaaaagttcctttgaatatttttatgttggccaataggcccctccatatcctttccaagggttttaaggggggttccgtgccacgtattgatatagatttgaccctctttcttttgaaagtaggtaggaaaggtaacgttattgattaaatactttgctttagtcaaatatttaatatattcctcactatgaactttaacaaatcttacatttttcaagcctttatacttttgggcataaggattgtcctgatcatttaaagcccatatatgggtgaaatttttgtattcttcattgtttattaaatgcttaaatattgcaaatggattgtcattcattgcttttccatgataagattcgtagaaaataatattttgatcaattctattcttcttgaaattccttgcgaatttaacagtgcgtttgaattttttattgttggtgtaagttttaaaaggctctaataaaaacttcgcccttcttttagctatttttaatttcttattcattccaagctcctctattttcttacttattttaaaggtgaatttattagcaaatcccatacacaagaaaattaatttttaggtgattaaacttgacttaatcatcttaattttaatacctctcacaaagtttctaaaaaggaaatatcaaggagtaaatcttttccctacagttttatacatgacaaccataatagcataagtttctctaaaagttaagaatctttggcagccactaagagggctacaatacattaacaattataagaaagccattgcaataatacaatggctttgaaatggtcattaatggagatttttattcaaaaattctattcaccactttttcagaagaattgcccgtctccaggtaacaaaacttttcataaaaaggctcaaaaatgtcaggcagacgatagtcagatgtctctgtttccttgattttctcaattacttcctcagtcgttttgaccaacggtcctggtgcttcttgttcaaagtcaaaataaaagccgcgcagcttgtcacgataggtttcaatgtctggaacgaagaaaatcatcggacgcttcaaatttgcgaaatcaaagaatactgaagagtaatctgtaattaacaaatcagataccatataaagttcgcgaatatcttcgtatgatgagaaatcatatgcgaatcctttgtacggcgataggtcaaagttttccgcgactaaatagtgcattcttaaaacgatgacataattatcgccgatctcctctcgcagcttttccaaattcaaatcaaggtcgaatttgtattttccttttttatagaactgatcgtcccgccatgtcggtgcatataaaatgacctttttatcttcgggaatattcatttttctctttatggccttcatcgtttccggacggttgtctgtgtacagaaagtcatttctagggtagccggactcaatcattgttttgttaaattgaaaagcgcgggcaaagatttcagttgaataacgattcggggatattaaatagtcccacttcgatgcttctttagtgaaattttgcttgtacttctcagtgttggtacccggcatgtgcacttcttccatatcgacggcaagccttttcagcggagtcccgtgccatgtctgcacatatgtcgtatgctttggtttcggtatccataaaggaagccggctgtttacaacccaatattccgcccttgccatggcaaacagccacttcagcgtaaatcggttaatataagggacatttttttcttcgaaaatttctgtataactcgggtttacactccatattaagttgtattccggatgatgttcattcatatactcgtaaattgctctcggattgcagctgtactgcttaccggcaaagctttcaaaaatgacggttttctttttaacaggcagtttgccggccagtccaaaagtaaaatagtatgctctcttcaccatgcccgaaatctttttctttactttattcttgcctttgcgaatgactgacatcagccttttgctctttcctttggcaaaataaaccgcacgggttttgatcgtatagtcgttcattcttagacgcataccccgttttcgtttctgcggatagatgtgaaagcgagccggtcctttttttgtgtcaacaattgaaaaactgtctatatcatctataagcctgaatgccctgctttttataacggtttcctcccctgttacagcatcttcacctacgtattctatataaaactgaaagaaagcaggcatcctgttctcttcatacagctttttcagatcgatttcagcctcaaatccaacggcatgatctgaagaatgagctgacaaatcgctgcgctgaacgtcttttaaaggaaaaatgaaaaccctttccttatctttttgactaatttcctttaaaaccagccttctgctttttattatcgaacattcttccgcatcgagcagaaaagtatagcctctgatcattagttttccttcggagcttaacttaatgctgtccggttccgctactgcttttctccgtgaaacatcaagagcgaagtggccttttcgggtcgtatacggcaaataaatgaactgtttgactcgatcctgatgccaatacagctcaatcggttttgaggctgtgtaaatcctctttttacattgatttttttcattattttcatatagcacataaaaatcaatgaccgtttcgtctattatcaggttagaaaggttatttaaagatatctccgctgcttttaactgccctgaatcgcttattttgttacaagttacacgcatctcttttttcgaattgcggttcactgccaaaataccgacatgattaagagagatagaactttcgaacacaaaatagaggcgagcgtcgttaatttttatttctcgcagctgaaattctatcggaattgcactatccataaaatcagtctactcctctttttttattcaaaagcaaagccgttcatacttattatattaaaatgattcgtatacgaaacaaaaagcacttcttattttttttaagaagtactttttgaattttatttaactgagccgacattaaaggttcgcgatttcctctttgatcttcgtcgtggaaatcccttcggttctcggaaggtaaacaacctcgcaatgatccttcaggaagtcgaattttccttcccagtcatcccccatgacaaatacatcgatgtcatggtcgatcacatcttgtaccttttgatcccagtttttttccgggatgacttcgtctacatagcggatcgtttctagaatgagcttgcggtgctcatagctgtgataagcttttttctgcttttgaagattgaattcgtcagtcgaaatcgctacgacgagataatcccccaattgttttgcccgttccaataacttgatatgtccccaatgtaataaatcaaacgttccatatgtgatgactttcttcattgtcatgcgctctcctttctaatcttaaggcgaaaagctatattgatatatcaaaaacactcgataagttacattcattccacaggtctttactgatcattcattatagcacatcgcctatcaaacgttaagtattctttaaggttaatgcaattccaaattttatctaaaaaaatcaaaccttttctgaataagacgtaaaaaatcttaatctaatgtaaagatattgttaagcttttatgaatgatctatgctaaaatatacgttagacctcctgaatttatgggctggtctcttaaacttcgactttcatacattcgtatatacttacacttcttaaaccggaaggaggaaaaaaactatgctgcaaacggaaacggttcatcatcttgcatatgttaacggggatttgcccggatttttgaatcatcttgaaaaatcctttatcgaccgcaatgagggggcatttatcgcaacggtaaaccctgagatcgggtatgcggctgcaaaagacaaggattattttaaaacagtttcatctgctgactttatcctgccggacggaatcggcatcgtcctgacgtcaaggctgatcaacagcagattaaaatcgaggatcgcggggtacgatgtatttatcaaccttctcagcttggctgaccgcaaaaagaaaagggtctttttatacggggccaaacaggaggttattcaagctgttgcagatcggctttcaaccgaatatcccggaattgagctggccggatactcacacggctatgtcaaagacaaaggcgaagttgcgaagcaaatcgcggctgccaagccggacatggtttttgtcgctctcggatatcctcatcaggaaaagtttatttatgaacataagcatctatttcctcaggcgattgcgatcggcatcggcgggagcttcgacgtgttcagcggaaaagtgaaaagggcgccgaaaatgttcatcaagctgaatcttgaatggatgtaccgcctgctgaccaatccgacaaggtggaagcgcatgctgaacatcccgaaatatgtcttctccgttctgaaagaggaaagagttcaaaaacagcggcactactatccggagcagatcaaagagcaatctaaaatcgatttgtagaaaagagtttgggtaacgaatgaatatacgttctttattggttatggtttactcggccggtctcgctttgaccggttttattttcagattggtaaaagcgcgcgacagagctgtattgcttgtttcctttccggataatgcgcgcgcgctgcttgatgagtatgtcagcagcagccggccgtttgaaatggaagtcctctatacaaggcacgccgtttcccttgcagatgaatatccttccgttcgatcgcaagtgatcaacgagaaaaatccgattcatctcataaaagccgtataccgaatgttcaggtgtaaattcgtgttgacggataattattttctgctgacaagtgttttgaataaacgccctcagacgacatgcattcaaatttggcatgcgtccggcgctttgaagaagttcggactcgaagatatcggaaaccgctatcgatccgccggcgatatcaaacggtttaaaaaagtgtatcgttcatttgatcatatcgttgtcggctcggaaaaaatggcggatattttcaagcggtcattcggcttgggagatgaccgttttttgcggacgggtgttccgttaactgatgagtattttcatgccggaagacaaacagcggaccgtccggaccaaaaggttattctgtatgcgccgacatacagggactattgtttgacgtccgttcgtctccctttctctaaggagcagctctccggggaactgcagggagaatttttgctgctggtcaaactgcatccggccgtgcgggaacagattgcttttgaagagcacgaagggctgatcaaagacgtatcagacgttccgttaaaggatttgctgatggaaagcgacatcctgatttccgactactcgtcggtcgcctttgagtacgctttgttaaataaaccgattttgtttttcacgtatgatatggcagagtataatgaaaaacgcggactgatcgatgattttgaagcagtcattcccggcaaagcctgcatggacagcgaaatgctgctgaaagaaatcaaagaaatgtccgatacaaaggaagagatcaagaagtttgcggaagagtggcatcaatattcaacaggtgatgccagcatgcgcctgttgaactttatgagcgagcatatgacggcaaatgaaaaaagaccggccggttcctaatggaacacggccggtctttttatgatgattaccgataaaccggcacatcatagtacagcgtatattgatcgagcaatgtatacagactgtacattctccccacctgcttataagcccatccgacatctgtcgcatattggtgaagggcattcggagaccatctcattttatagagggtgtcctgtttgtaagtcgggtggtgaatgtatttttcaccgatgaatttggctccgcccataatggcggcctcaggtgtgaaccacccttgttcataggcgtattttgcgccgtagtaaagcgggttgctgtcgtaagccccgacgccgtacatattgtaaacctttttgccgttgaacatcgttcctttagccaactcggaagttccgttgcccgtctcaaggagcgagtgtgaaatgaggtacagttcattgatgctgtatgctctcgccgcgtcgatgaacgcttgccctttgcctgtcaaaatccctttattataaaggatttttgcattgacctcggcagcattcaatctggccgtttgcgacagttttaaaaattggaagtatgccgagctgtcttgtgtgaaattttccggattgacatatttctcgacttcatccctgctggcatttcgccaattcattctgatttttgcccagccgttttcctgggagatgatgttgactttatcccctttttgcagctgtccgatgatgttgccgcctgtcacaagggggcttgacctgatattcagcagatcagccgtgacggtttggttcgccgtattgatgtagctcaatgaaacataagccggcgcatccgtttgcgggctgactttcatctgtttatcgatcatctggctgagcgtgattccgtagtcagtcgttgtgatttgcgggccgtttttcactttgacgacattcaccggccagccgtaattcgttttgatccgattggcggcagcatccgcacggtctttccctgtaaattgttcattgatcgagatatgaaacaggctgaccgtctttgtttggtaagttgcgctgacattgttcttcttaaagacattcaagcccttgtcgagatctgctttgcttgtgattcgacctgtcgtcacccggtactgcctgtagccgtactcacccgtttgttcaatcttgcccggtatattccgcttgctgaaaaatccgagcgcctgctgtaattgttccgtgccgatcagagcttccgaactcagtttgtagcggctgtaatattggccggtcttcacggcctctgcgtgaatgcctgtttctttaaagaaattgagcgcctgcgtcactttgttctgttcgtatacggattccgttgtcagctgatagtggctgtacactttttttcctgttgatccggccgttcccgccgcaccgtttttcttaaagaattcaagccctttattgattcgcgcttgaacggcggtttcagcagacgcaatccggaagcggctgacggtcgtgctgccggtgctttgcgcagaagcctgaatatttttgtttttaaaaaaccggatgccatcgtttgctttcttttgatctgaaagcgggacggaaacgattctgaaagatgtctgctttttccccgcctttgcagcagtataacgccacgttttctttttgaaaaaggcgtcgatttttttgaggttttgactgtctacgcttttcatgcttacgatccagaagcgtgtaccttttaccttttccgtgcttgaggcgagaccggttttctttttaatttgtccggcggcatttttcgcgctcttttcgtcattaaaatatcccgatttcacattgtatagctgtgccggctgaccggcggcttcatatgcccctttgactttgagctctttttcaaactgcttcagcaggtttttcgcgtttgtttcgccttgtatcgaacttgtcgcaattttatatttaggctgttgtttctttacggtctctatcgttcctttaagggccgtttctttttcaaactggacaagcaggcttttcgctttgctctcatctgcgatttctgcagaataaatcttgacgatcgcttgtcccgctccgtatggtgcatacgacgctttgaggccggtcgctttttgaaaacgatcgaggatggctttcgtgttgtcttcgccttcgattcctccggtggcaaccttcacgtatgcttccctgttccctgcaagtgtataggttgctttcagaccggtttctttttcaaattggagcgcccattccttggctttttcttcaccggcaaattcctttgataccgctttggaaaacggttctttttttccaatcggaccataggacgccttcaaaccggtttctttttcaaactgcaaaagcagattttttgctctgctctccccttcgacaccttctgatgtcaaaacgtatgttgtgccgtttttccctgaaggtttgacctcggctttccatcccgtgtcctttttcagttgttcggctgctttgagcgcttcgctttcgctattaaactcttttgctgtttcaattttgtagacggaagtatcggtatatgctgctaaagcaggaattgccgggactgccgtatgtacgagcaaaatgattgcagcaaaaataacggtttttctaatgtttttcacattctttactcccctcgcctatgagcctcccaatttctaaaacttgctttctctttttatcggcgagccggattatttttttacaataaaaaagcttaacggcctttttttgcagaccgtcaagctttttatatgtgtgacacgattagttcacatgttccttctattgtaaagtcattggtttccgccggcaggataaaatttgtccctttgctgatcggaaataattcgccgccctgagtgagctttccttctccttcaatcacgctgcacaggaggaaaggggcatcctgggtcagctcagcggcaccgtcgatctcccatttatatacggagaaatattcggcttcaacaaatgtcttaatggtaatgcctttttgagtttctgtcgattcgtcaacatagctgtctacatgcggtactgttgtgacattgatcgcctgtgtcaggtgaagttcgcgcttttctccgttttgatcggtccggtcataatcatataccctgtacgtcgtatcggagctctgctgtgtctccaaaacgaccgtcccctcgcaaagagcgtgaatcgtgccgcttggcacataataaaaatcgcccggtttgattttgatccgccttaacaggttgtcccaatcaccgctgttgatcatggtgaccagttcagtccgcgttctcgccgtgtggccgtaaacgatctctgctccttctttgcaatcgatgatataccagcattctgtcttaccgagttccccgttttcgtgctctcctgcataatagtcatccgggtggacttgaacggaaaggtcttgattggcatcaagtattttcgttaacagcgggaaacggtccccctctgcacctccaaacaattcacggtgttcgtcccaaagctcggcaagcgtttttcctttgtaaggacctgaagcaacgatgttcggaccgtttggatgggcggaaatggcccagcattcacctgtcaaatcggagggaatgtcatagccgaatgactcgcgcaaagccgttcccccccagattctctctttaaactcaggctgcagaaatatcggtgattgagtcatgctgccatctcctcccttaattcacgatagtcttatgtaaataaaacgctttcttttattgatagacatgtatgttgaaatataaaccttttcatattcattatgacgttatctcgatagaagtcaatgccggaaaggaaaaacagaagccctcttcaggcttctgcttgtgatgatgcaagctcaataatccgctggtttgagcttcctctgtaaaggagcgtcaagtccctttttttgagttcgaacgggccgtctaccaggacatcgcaataggccagcaaggcgctgtgcttttcattcttcaagatttgttcgtacgtatagccgctgtaaagccagatgtccttttcggaatgctgcttaattttttctgacagctcgatcagttcgcctgcatgcaaaagcggctcccctcctgaataggtgacgtttgtaagcgggtttttcataatttcctcgaatacttcgtctacactcatatcaaatccgttattgatattccagctttgtttattatggcagccttcacacatatgcgggcagcccgctaaaaacacgactgttctcagtccttctccgtctacgatgctgtcatggataatattcatcactttcatagatgcttcactctgtccttttcttcttgtcttttcgccgaattccactttgacatatctccgactaaatatcctgtaatccgtctgattcgttcgatcaaagcctcatcccggtttttgcactgcgggcattcattatctatgattccggtaaatccgcacgccttgcagtggtcgacaggatggttgatcgaggcgtagcccatgcctgaccggcgcatggcggtcacaagcatgtccatcgctttaatgttttttttcgggtctccgtccagctcgatgtagctgatgtgccctccattgcacattaagtggaacggcgcttcttttctgatcttttcgaccgcagtcagcttatagtgaacagggatgtgaaacgaattcgtatagtacacccggtctgtgacattgcggatcgaaccgaactccactttgtcttttttgacaaatttccctgaaagcccttctgccggcgtagcgatcaaggaaaagttcaatttgtgtttttctgtggcttcatcggccttatctctcatcgactggacgatttttttgccgagttcaaacgactcctcgctttctccgtgatgttttccggtcaatgcagtcaaagcttcagccagcccgataaatccgatgctcaatgttccgtgctttagcacatcctcgagcgtgtcctcaggttcaagcttctcgctttcatgccagatgccttgtgaatacaggaatttaaagtcctttgctcttttcttgcattgaaaggcgtaccgttcaagcagctgttgaatcgttaaatccatgtagcggtttaacaaggcaaaaaactgttcaacgttttcgctgagcagcgctattttcacaatgttgatcgaggtgaatgacaaattccctctgccgacgctgttttcttttccatgaatattggacatgacgcgcgttctgcatcccatataagcgatttcgctttccggcgttccgtcataaaaaggtttgttcacgggcgagtcgataaagctgaagttcggaaacagcctttcagcgctcgtttccaatgcaagccggtacaagtcatagttagggtctgtttgatcaacgttcacgccttctttcattttgaagatctgaatcggaaaaatcggcgtctcacctttgccgaggcctgcttttgtcgccttaagaatatttttgatcaaaaggcggccttcccttgacgtatccgtgccgtaattaatggaaacaaacggcacctggccgccgcccctcgaatgcatgctgttggcgttatgtataaatgcttcgcacgcttggtaagttgtgttgtccgtttcttcccacgctctttcccttatctcttcttctgtcaaagttgtcgggtattgtttgattttcgcaagatgcttttcgtacgttttgcggacgtaaggcgccaggtcgtaatcgaacattgggaatgactggccgccatgctgcatattttgattcgattgaaaaatgatagatgcgagtgacaatgcgctcataatgtccttcggttccctgagggagccgtggccagtgtggaatccctcctttaacagccggaccaatggtatctgacagcaagtcgttgtcccgctcggcatatagtctaaatcgtgagggtatataaagttgtcatcgactgctttcttgatttccggcgacattaagtaatggagcgcataatgtctggaactctcggatgcaaaccggctcatttgccccatcggggagcggccgtctacgttggcattttcctgcataatatcgtgatttccatacccgacgatatcatgaaatgtttctgtcaattgcaataatccctgttctttaaagcctgttgtcatcctaatctctcctaaaaagtagcatatatagtgtttgttcatccaacagacactatatattgatattagcacagattatgttcgtcaaatttagcaatttggtgacgtttcaaaaacggtcataaaaaaacgccccggacaaatgtcccggtgcgcctgcggcaacattacttgtaatcaatcgtcatttgtttcggagattttctttgtttcgtccgtttttcgatccagacggttgcaagcggcgtcagaagcgaggtgacaatgacgcttgtcgcgatgatcgcggttgctgaatcagctaccggcgcaaacacggggtttgcatcggcaagtgcatacgggacggctaccgcagccccggccgttgatgacgccgctactcccgcgacaccgtctcctcttgcgacaaagcggtccagcaagtatagagatgcacccgagagaatgacgactgatacgccgacaacaatgcctaaaaggccggattgaatcaacatgttaaaatcaagcgtgtttccaagtgaaaatgcgaagaacggaatgatcgccggtacgacttttccgaacaaatcgcgcaattcagggtcaaggttaccgagaatgcagccgagtaaaaacgggatgacggttgcagccagcgtctcccaaggaaatgccgcaagccctgtcacaccgaaagtgaccatcgtcataaacgggcctgattccgtgctgataaaggcaaaagcaccggcgtcttcctttcttcccatgtgattcattaacgccaaatacagaccgccgttcgtttcattcataacggctacgatcgccagcacggacagtccggcaaaaaacccgctttgaatgccttcgtctggaatgaactgcgctgcgatcaaacccaataatgcggcaaagccgactttgccgatcagaagcgtcagccccttcctcgcaatatatcctgaagaacgaaaatctattgtcgcgccaacgcaaaagataaatactcctaaaatcggcagcgttccggtaatcagggcgcctgtaaatccgccgaaaaactctgcggttcccggtgcaaatgtattcagcgttgcgcccagaaagagcggaatgatcatcatgccgcccggcacacgttcaatcgttgctttaattttcatcatttttttctcccattctagaaattaatgaaaaagcaaagctgtcgatcttgcaaaacctgaagtctttaccacgctgcgcacgctttatttctgctgagcccgccgctgaaagatgcgctggagatccgcttctgacactttgttcagctggcttcccacacctactgccaatgctccggcatcaagccacttctccacatcgccgggatggattcctccggttggtatgaaccgaaccttcggaaaaggaccggcgaggttcttcatgtaaggaatcccggatgttccccctggaaacagcttaagaacccgaaaaccctttgagaccgcttccataatttcgcttggcgttaatacgccgggaataaaaaatgtatgcaatgatgcggcctcctcagccagtgattccgaaaaacccgggctgacgataaattttgaccccgctgccgcggcttccctcgcctgttcgctttcaaccaccgttcccgctccgacaagaagaccgtcttttcccgcaaatttttcaatcagctcagacgctcccggcgtcgtatatgtgatttcaatcgcagtaatccctttgtcgatcagtctgtgaatggtctcctcagcagcctccttaccgtctgcgcggacgactgcgatcagcccggcctcgcccagctgctcttgcacttttccgatcatagacatttccattacggtcaacctcctattttttggttgtttttctctccagccataaaagctttcaattgatcccttgacggcagaccgtccatatcccccggagccatgacggccagcgctccgatcgcattggccctctgaactgcttcttccagcggaagtccgtctaaaaggccgctgatcatgccgacggcaaaaccgtcgccagcgccaacagtatcaacaaccttctccacctgataacccggcacataaccttctttttccgatgtcctgtaataagccccttcttttccaagcttgatgacaatcaccttgaccccctgcattacataatgtttagcgatatcctcgggagaattgcagcctgtcaggagttttccttcattgatccccggcagaaaccagtctgcctgcgcggcgatttcattaattgtatgaaccattgtctgctgatccggccaaagctggaagcggagattcgggtcaaacgaaatcgtcttcccgtcttttttcatctggtgaacggcgtggcgggcgaagcccctcatttcccttgaaagtgcaggaggtatgcccgtcacatgcatatgtttggcttgcttgaaatactctgccgggtagtcatcaatgctcatcgtgcttgcggctgatccgctccgataatatgtgacatcagggtctccgctttcaacctttgacttgagcagtatgcccgtctgccggtctgcggtgcgtttgacttcagaaatgtcgacgccttcttttttcaattcatttaaaataaaggttccgagcgaatcggcgccgaccttgctcatccagccgacccgaaaacccaggcgcgacagtccgacggcaacgtttgtttccgctccggcaagagctttggaaaacgaagacgcctcatgcagtccgcctgcttcatttgcgtaaaacatagccatcgattctccgaaggtcatcacatcaagcgacatgatttcactctcctttcaaaatggtaccggtttcaaaagcagttgcgggaaaacactctcccctaagttttcgggtccatgagtgtttccgtttgacaagttctacagcgactgtctgagaacaagctccgcctcaagctgaatcgtctgcggggcgctttcgtctccttcaatccgtttgatgatccgctccatggcgaccctgcccatttcatgcgacggctgggcgatggtcgtaatgcccggaccgatcaatttataccattctgtatcatcaaatccggcaattccgacatcttccggaattgaaatgccaagctcataaaggcagctgatgattttcagcatcagaagcccgttgtttccaagaatggcttttttcccttctttcatttccaaaaagcttttgacggactgtaatagagattctttgtctttgacgtcagcctcatatacgagaggggtaccgccggcgtttcgttccagcgcgatttctgtataggcggaggccctttcctcccttggactgattcccttaatcggttcggtaaacagaccgacctgggcatagcctttgtcatacatgagattgacgatttgacttgtcacttcgcggttgttcgttgtgactgcatcgatcttgagcccgggcactttccggtcaacgagcacaatcgatacatcctggctgattaaatccaagagcacatcgttgttccttcccgtcgtattaataatcagcccttcaatgtaatgcgcgttcagcttgtgcagcatctccctttctttctcaggactgttgtccgtgttgcagaccatgatgctgtatccgtactgatcgcaaacctcttccacccctctcaaggtggctactgaaaacgggtttgtaatatcggcgaccaaaaatccgataactttgctttttttcaccttcagcccctgtgccatctggcttgggcggtaattgagctcctcgatcgcttttttgatgcttttcacctttttcggtgaaatggcatcaatcttcccgttgatataacgggaaaccgttgattttgatacgcctgcatgtgcggcgacttcgttgatggttactttcgctgtttgcttatccttcattcaagtactcctataaccttatgatttgaaaccgatttcaaaaactttataccaccagcatatcacatcatttaaaatttggaagagtcttttttaatatttcagcattgtcctttacaatattcagaaaaaagtgaaaagactgttgacgctttccattatttactttaaaattcatgtttgaaaccgttaccaaaaacttttggcacttcattcaagtcagtctaaaaacgtccaattcaaggaggagaaggtatggaaaatcgttattctgttcatccagaacaagcgaaacgattcacaaccgcagagcttcgcgagcattttttaatagagtcattgtttgttgaaaacaaactgaatatgttttattcgcatgaagacagggtcgtgatcggcggagccgttccagtaaaggagtccatagcgctcgatgccggcgattttttaaaaacggactatttcctagaacggcgcgaaatcgggattgtgaatgtcggcaagcccggtgcggttaaagtcggtgatgaagaatacgtactggagcacaaagactttctgtatatcggcctgggaaataaagacgttttcttctcaagcttgaatgaaggcggggccaaattttatttcatctcggcgacggcacaccaaaagtatccggtgcaaaaagcttctctttcagagctcccatacgatcatttaggagaagaagcctcttcaaatgttcgtaatctatacaaagtgattcatgcagacggcattcaaagctgccagctgatgatgggcattacgtttcttgaacctaataacacatggaacacaatgcctgcgcatgtccacgaccggcggatggaggtttacctgtatcttgatcttgctgaggatgcaaaggtgtttcatttcatgggcgaaccgacggagacccggcatcttgtcgtcgggaacgaacaggctgtcatttcacccgcgtggtctgtccactcgggctccggcacatccaactactgctttatatgggcgatggccggagaaaactacacatttaaggacatggatgctgtcccgatgaatgtcattcggtaaggacgtgaacgtgagatgggatatcttgaatcgtatttttcacttgaaggcaaaacggcgcttgtcacaggcccgggaacgggaatcggcaaagggattgccgaagcgctggcaaaagcgggagcggatatcatcggcacttcgcatacgagcggacttgatgaaacaaagcggctgatcgaagaagccggcagaacgtttacttcttatcagcttgatatgggcaaccttgacgaggtcgaggcttttgcaaaagaggtgcctgaccgccatcaaattgatattctcgttaacaacgccgggacgatccgcagagaaaaagcggctgatttttcccgggagaactgggaagcggtgatcaatgtcaatttgaacagcttatttttgctgacgcaggctatcggccggcagatgattgagcgaaagcaagggaaaatcatcaatattgcctctcttctttcatttcaaggaggcattcttgtccctgcatatacggcaagcaaacatgcagtagccggattgacgaagtcttttgccaatgaatgggcggcttataatgtccaggtcaatgcgattgctccgggctatatcgcgacgaacaatacaaagcagatccgcgacgatcaaaaccgcaatgccgaaatcttaaaacggattccggccgagcgctggggtcagccggatgacattgccggcgccgccgtattcctttcgtcgccggcatccgattatgtgaatggacatgtgttagccgtcgatggcggatggctggcaaggtaatgcgaggaaaaggctgccggtagctcggcagcctttatcatcgctatggcttcaaaattactttaatgcaatcatcttcatggtcgttgaacaaatgataagcgcggccggcttcttcaagcggaagctggtgcgtaatgatttccttcggatcaaattgattctcttcgatcttcttgtaaatctccggcatcaaatggatgaccggagcctgccccatttttagcgtaacatttctggaaaagaatgcgccgagcggaaacatattgtaattgcttccatatacccccgtaatctgtacggttccgcactttctgaccgcctttgtagaaatttgaatcggtccgagcgtgccgccctgaagcttcagtttttgctccagatactcaagcggagattttttgccgtccatccctacgcagtcgatcacgacatccgccccgccttttgtaatctcctttaaatgctcgcccatatcaggatattttgtaaagtcaaatacttcaacgcggtttaatgcctcagcctgctttaggcggtagtccaagtagtctactgcaatgacccgcttcgccccttccatccaggcaaacttctgcgccattaatccaaccggcccgcagccgagcacaatgacagtgtccccttttttgacgcctgcgtgaagcacgctccaatacgcggttgggaggacatctgataaaaacagaagcgactcgtcctccatctcgcatgattcaggaatgacaaacggcgtgaaattgccaaacggcacttttaaatattcagcctgtccgccagggtgattcccgaatttttccgagtagccaaaatacccgcctgaatcataatggggattggcattgtcgcactggctttccagcttgttttcgcaataaaagcaatgtccgcaggcaacggtaaacgggatgacaacccggtctccttttttcacttttgttacatcaggtcctgtttcttctacaattcccatcggttcatggccgagctggaagccttttggaagagggaaattcccttgataaagatggagatccgaaccgcaaatcgcggtagaagtaattctgacaacgatatcatcgcttttttcaattttggcatcctccacctggctgacttcaacatgctgaggcccttgaaacgttacggctttcaaatcgtcacactcccattatcgttcagttgactttagtgtgagataaacccgggttcttattcagttttttaaacaaacgtttcattagccgtcatgtagaacggccatgattcatacatagaagaaaacggaggtgttgggatgctgctgcaaatactggtcggaggactggttgttttcattattttttttctcgtgtttcgggcaatcagaacgggcaatctgccgcgccatgacgattcgcagccaggagacggagagaacagagatcagccatgatcggccggcctcttcacacaaaaaaggatggggccttgcccatccttttgcctatcgttcaaccggctgtgtgtcagttgccgtgattccgcggtgcttgtcccgcaaatcctgctcgatctcttccagactttttccttttgtttctgttactttaaagaagacgaacaggaaggccgcgattccaatggccgcatagcacagaaacaggtaactgatgcccatcgcttccatgaggaccggaaaactcaaagtcacaattaagttccctgcatggagcattaaagtcgatactccggttcctatccctctgacatgaagggggaacagctcaggcagcatcacccagacgatcggcccccagctgacggcaaatacgacgatgaacacacctaagcagatgacagtcgtccatgccgcaccagaggtattgccgaaaaagagattagaaaaagaaagcacgatcaaactgatgaccattccggcatttccaaataataaaagcggcttccggccaatcctgtcaatgaagcggatcgccacaagcgtcatcaggacattgaccgttccgatgccgactgtccctaaaatggccgccgaatcttcaaatccgacattcgtaaacgtttttggggcatagtaaataatcgtgttggttccaataaattgctgcagaaatgccagtccgacccctgcgattaacgccgggcgcacccacggttccagcagctctttcaagccccctggtcctgcttttccgcttccttaatttctttgacttcctgatcgacccgctctcctcctctcatctttgacaaaacccgccttgctttctcttcttttccttttgttaagagccagcgcgggctttccggcatgaaaaagataccgattaaaaggccgattgacggaataagggccaatcccagcatccagcgccatgcgcctgcatcactaaatgcatagttgatcaaataagagagcagaatcccgatcgtaatcatcagctgatttaatgaagaaagcgcgccccgggattccttcggagcaagctctgaaaggtacaaaggaacgatggtcgttgaacagccgactgcaaggccgagcacgatcctgaaagccaccatatattccgtgcttggcgccagggccgttccgagccccccgatgcaatacagcacagccgctgacataatcgcccttcttcggccgaagcggtctgtcagcctgcctgacaaacccgatccgaaaatcgccccgattaatattgcgctgacaaccagcccttctgtaaaggcattgagcccaagttcatctttcataaacaaaatcgccccggaaatgacgcctgtatcataaccgtagagcacaccgcccaaggctccaaaaaaataaagccaggcattcgatctttttcccttcatcacagtatatcctcctccaaggctcgtcttttaacctttaaccttgtcttgctttcttcaaacctctagaaactcggagtaccattaaaaggaatttaaaaatatgaaacattttatctgttatatcgtcttattataggcggcaaaatgatcagtcccgcggaatttccagagaatccccatatgcaaaacagcaaatatattgtaaaatccaagattgggaaactattttttattaaaatttagacttattcaacaattgtacgtttcaatataaataaaagaggagcttatacatgctacgatcgcagcgaacgaagaaaaagagactaagaaaatgggtgaaatactcactgtttttcattgccttaatcctgacggcgacggcagccgcaggcggctatgcgtactataaagtggcgaacgcctccaaagatgcgcaagtcaccctttccagaggtgaacagtccgtcaagcggattaaagagttcaaccctaaaaaagataacttctccatcctgttgatggggattgatgcccgtcccggacaaagcatggacaaagaacgaagcgatgcgatggttcttgccacgttcaacagaaaagacaaatcggtgaaactattgagcatcccgcgggattcctatgtcaacatccccggacgcggctacgataaaataacgcatgcccactcattaggcgggcgcgaccttagtacagaaaccgtcgaaaacctgctcgacattccggttgattacgtcatggaagccaatttttcagctttcaaggaagtagttgatgaactcggcggtgtaccgatcacgatcaaagaagactatattgtccggcagattaaaaaggatacgaaaggcaaagtcaaccttcaaacaggcgagcagacgctgggcggagaagaagccctcgcttatgtaagaacgagaaaagccgatacggacttgaagcgcggcgagcgccagatggaagtcatcaaatcgattatcaacaaatccaaatcgcttacttccattccggcttacgacgatatccttgatacagtcggaaagaacgtatcgatgaacttgtcgctgaatgatgcaatcggactgatcccgtttatgacgtccattcaaacggtcgatacccttcaattgaaagggagcgattatcaaccgggcaaagtctactatttccagcttgatcaggaaaacctcaacgaaattaagcaggaattaaaacagcagttagatgtataattagaaaaaggatgaatcatattcatcctttttctgttttaatgaaactcaatatttactattgaaaaaatctaaatttaggtttagccttttacataacatgtctttttagggaatactgccgaagagagctgtttttcgcctcccgaaaaacggcaaactgctcttacaggaggttatctttacataatgagattaattgcgatcgatttagacgggactcttttaaataccgaaagcaaaatatccgcagaaaaccgggccgctatcaaaaaggcgctcatttcagactgcatcgtaaccatttgcacgggacgggccacatttgacgtaaaagcgcttctgaacgatttggatattccgattatcgctgcaaacgggggaacggtccacgatttcaactataaactcctaagcagaacgctaatggacaaggaagcgggaaaaaaggccgcccaatacttaacagatcatcaaatctatttcgaggtttatacggacgatgcgctgctttctccttatgacggagagcagaagcttaaagcagagctcgatatcgtcacaagcgccaaccctgatgaagacagggatacgctttggcaaggcgcactgactcagtttaaacaattcggcatcaaacccgtccccgacattcgcgagatttttaacggagacgaacatatttataagctgttgtgcttctcatttgatatggaaaagctgaagaaagcaaaagatgatctttctgcctttccaaaactgggactcacttcttccggaagacatatcatcgagattctgcctgatgaatccggcaaaggccgcgctttaaaagagctggcccgccactatggaatcgagaaaaaagacatctacgcgatcggcgacagcccgaacgatctgtcaatgtttgaggaagccggccatcggatcgcgatgggcaatgcaatcgatgagctaaagcatatcagcacctttatcacgaaaagcaatgacgaaaacggcgtcgcttatttcattaacaaactgctggaaaatgaatatcaataaataagaaaaccgctcgagtccatcttcgagcggtttttttgctgtttctgctactcaattctgacgcttccggcgtatttatctttccaataggcgctcgtctccatatctgctgtcgttacaccggcagacaaggtgacaagaacgacctggccgtttccgatatagatggcgggattcataacagtggttcctttaaagaagacgatgtctccaggctcaagctcctgtttggtaattttcttacccgtgctgtattgtttgtcagcatacctcggaagctccactcctgccgccgttttgtagacatattggataaacccagccgtatcaaagccttctttaggcgatgtgccgcctttttgataaccgacttcgccgatatgcctgatggcttcggatacaatcggattttttggcagggacatgttgtcaaaacgtctgactcctgtgaacttcttctgccaataggaagccgacaagtaggatatcgtcactttatttgaacggctcgcatggataaaccgcccgcccccggcatagatgccgttatgggatattcccggtttgtacgtattgctgaaaaacaaaacatcacccggccggatatcttcaagcttcaccttttgaccgacagcccattgctgttcagccgaccttggcaaataaacgccgagcacctctctgaagacgtattgggtcaaccccgaacagtcaaatccgagatccggagagttgcctccaaatacataaggaacaccgacatagctttttgctttttgaacgacaggatccatcgaaatctcaggctcttttgtgatccttttcgctttaaaataccccgagctccagtaagagctgccttcaagctttgtcacgacaaccccgtttgattttgtgctgtggatgatttgatcatttcccaaatagatggcgacatgggtcggtccgtccgattccagctcggcattcttgaaaaagacaaggtcccccttttcgagctgctgacggccgacactgctcccaagagtcgattgttcctttaccgttctcggaagcgtaatatcgagcgattgaaacacatattgcacaaagcctgacgagtcaaaccccgttttcggcttctctccgccgtagctgtatttcgcaccctcaagctgtctggcagtttccgctattttctcgccgatcgtatcggcgcgtacatcattatgattcgttaaaaataaagacatccaaagcaccgcaattccacaaaacaaaaccaactttttgtttgccgctttttttatcaattgatctgttcctcctcttctttcctctttcatcgtcattcaactgggatatttaaaggactttttttgcatgtacagcagcgtcatagcgagaagaaacgctcagcacagcatgatcagctttttcacctaagcgcggattaaaaagatgaagggaaatattctaaagaggtcatgaacatgaggtgcggttcccatcccgaattggtaaggtgatgcattttcaaattttgcttcagtcgaaatttgtcagtttttattcccttcaaaagaatacaataaacatgaaccccaaaaccatgtatatatcctcctgattttctataaaactttatacactgaccggttaagaaaattgtcgtgtttccctttcaaaccggccgcttttcacaggtcttttataaccgggatcagcacacaaaaaagagagcgccggcggcactctcttttgcactgttattgcttgttttctgttgtttgatcctgctgattcactttttggatctccgtagagattttagctttttcatcgtttgacaattcatcagaatacttgaaagcagacatgaatgcaatgatcaaaactaaacctacgaacggccaaatggctctgacaaatttcatttgttcaccactccgtttttattatttttcagcttgtccgcatgatcgacttcaaacgttaattttccgttctcttctttccagtcgaggtttgttccttttgtcaattgacggaagatcgcttttcgttttaagaagtcgctcttgcctaaaggcgtcggcgttgcttcgcgaatgttgagaggcgttacctcaaagcgccctttgccgtcattcattaaatggtattgtacaagcgcgctgtcccgtgttcttgaccagccctgatcaaatacaaagttgccgaggctgtagaaaatcacagtaccgttatacacttcgatcggttcgagaacatggggatgagcgccgatgatgacatctgctccggcatctgcaatcgccttggccagatccttctgtctgtcgttcggttcattgtcatattcttgtccccagtgcacatggacaaggacaagatccgcttttttcgatgcttccgcaatcattggaataaagattttcggactgagcggcagcactccgcctctgttctttttggctgtaaagttctttgtgtagacgtctgtaaaaccgagcgttgcaatttttacgccgttcacattctgataggatacgtgctgtttcgcgtcttcaagattatttcctgctccgacaagctccagattctcatttgaaaatttattgagcgtatccttcaaaccgtcttccccgtagtccatcgcatggttgttggcaaaattcagtacgctgaagttcagctttttcaatgtttcgactgattcttgattcgtttgcagatggatgttcttttctgcctcttgatagtcctttgcattggttacagggttttcaaagtttcctgtgataaaatctgacacattaaagtacggcttcacatttttgaagacactttccgaaccgtgcaagtttgtcactttttctacgtttcttcccatcatgatatcgccaacaaaagtagctgtaagcttggcatcttcttttttgtccatttgcgaaggagttttggcgcttccgacccaagtaaagacaaacattaaacagaaaataacgggcaatacgataaagacgtgcttgtttgttttctttttctcctgcttcgtcagcttcagcagtttttcctgaaagttcagttgttttttcatcgatttgacacacctaactttagattagatagtaagcatacataatgacgaatgttgctccgctcaataaaagcgtacttccaagcgtaatcgttaatccctgtctttgaatggtattggcgatcagccccggcacgatgattccgattcccctgaattcggcaatctcaaacggcatcaccggatatataaaatcaaaaccgattttcaaaagaattcccgtaatcagcattgctgcgaattttctgcgtccgtatagaatcataattttggaaagtccgaatttcacgatgacatacgtcagcaaactgacaaaaagaacgagcagcatgaaaatcggctgattgaagacaagtcccaaataacccggtacgacgaggccggctggtacaattcccgttttctctgcaaaaatcaaactgagtaagactcctaaaatgagggcgatatataaatctgatccaaacattgtgttttcttcctcctagctaacgagctgcttaatcttgtaatcttgtattttttcaatgagaggctccgctgctccgtggatatttccgactccgtaaataacgcggccctcaagcttgtttttcagcatgaacatgatttcttccgttgatttgtgctcaaaatcaaacagcttgtccgcaggaattttgcctgcttcatatgctttgacgatcggctctgttgtttctccaatcagcacaagttcacttgcttcaatataaggaaggacatcttccgcaaactgctgtgttctgtctaccctgtcggcgcggcagttcataatgacgatcggctgatccgtaggatagcctatttcttttacacgcttccaaatgtttaaagtggaagctgcgtcattggccgcaaaaccgttgacgaaatgtccgggattcttggcgttcatcagcggcagaattctcatggctcccggatcaggcggcgcattcagcatgcctttaaaggcggtttcttcgtcaatgcccaacgcttgagctacaccgagcgcaagagacgcattatcagggaataccatgtactcaaactgtctgaggtattcatctgttattttagaattgtctgcgacgatgacttttgtgttcctttcttttgcaatttgcttaaagaaatcggtatactcactatcagtaataaccaaatgtccattataaggaatggttgctgtgaatgcttctgcgatttcatccaaagtcggtcccatcacatccatgtgatcctccagcacgttcacgatcacgccgatattagcctgaagcaattcttcctgaaagatgatttggtaatcaggattaacggccatgcactcactgacaatcgcattggcccctctttccaccgtttctttcataacctccttctgctctccgatattcggcccttgcggctttcttttgatcggcttctcttccggtgtgtcccaataaatcatccttgcgtctgtcccggttgtttttcctactgttttgtagcctgcttcgattaatatccctgttgttaatcttgtcaccgtggactttccgcgtataccgttgatgttcactcggacaggcagcgcatcgatattttgctggtggcgccttttttcataaatgccgatcccaacaacgatcacacaggctaatagcattacccacattgtttgtctacatctccttcttggaatctgatatgtaaattcattcatcagtatataggttcactatgaaatcacaatcggcattatgtaacagaagacgacgaaattttccgtgacaaagatcacctcgcccgagtcattaatgcctatctttttattgatatttttggaaatcgaaagttcttaattcctatcagatttttgtcagcgttttaagtatgcgctttcaaaattcgacattatgatttttgtacttttctccctatttcagatgaaaggttgaaggatggattcaggatctcttttttcccccggccgcaatcccctttaaatgggctgtcagccgggatgtctcttttcttttagtattttcgctcttttcgaacaggttaaaaagtcaccaatgttccctcttcaaaacaaatccgtcctatgacaatcagaccatctatcaaaaaatgaaaatctcttttagcataaagcgggattcattgacaaatccaaatattttgtgagtcgttcgatccaccttatttcttcagattttaggttaaaatcctaggatttaaaaagccattaatttttttcaatgataattcatcaaactttaacatttttaatttttcttactattctcattgttactgtattcgccattaaacgcccctatatatgtctcgatatcccagcccggtctaaaatttcagtgttcatccatttttttattgtgattttaaatggatcgtgataatctttatgtaaacggttacacaaatagagaggagaaggcttttttggctacgattaaagacgtcgcacttgctgcaaaagtatctgtcgctacggtttcccgggtattaaatgagacgggatacgttcatgaagacacgagggcgcgcgtgctgaaagcgatggaagaactgaattaccacccgaatgaagtagccaggtctctctataaaagggagtccagactgatcggactgctgctgccggatatcacaaacccgttctttcctcagcttgcccgcggcgttgaagatgagatccaccgcctcggctttcggctcatatttggaaacagcgatgaaaatctggaaaaagagcttgattatatgcagacgtttaaacaaaatcatgtggtcggagtcatttcagcgaccaattatccggatgcgccaaattatcaagacttgtccatgccgatcgtctttcttgaccggacgggcgagaatgcgccggctgtatttgcggacagccgcgaaggaggcagaatcgcagcggctgagatgatcaagaggaacgcgaaacggattacgctgattaaaggaccggctcaccttcagactgcaagagaccgtttcaacggagcgctggacgtgctaagcggagccgatatcgattttcacgtcatgaaaaccgagacattttcatttccggaagcccaaaaacgggcggcggagctgtttggcacatatccggaaacagacggcgtgatcgcaagcaatgacattgtggcgacagccgttttgcatgaagccttaaaacggaagatcaaagttcccgatgaactgcagattatcggctttgatgacataccgcaaagcgaattgcttttcccctctttatcaacgatcaggcagcccgcctatgaaatgggaaaagaagctgcaaaactgctgcttagattaatgaaaaatgaatatattgaacaatcggcagttcagatgccggttgcctttattgaaagacaaacgacaagaaaggcggaatgacaatgagtaaaatatgcgtgatcggcagctcttcgatggatttagtcgtgacatcgcccaagcggccggccgccggagaaacggtgcttggcgaatcttttaaaacggttccgggcggaaagggggccaaccaagcggtagccgcggcccggcttggcgccgaggtccatatgatcggctgcgtcggcgatgatcattacgggaaagccatcctcgacaattttcaagccaatggtgtcttgacagactatgtggaaccggttacaggtcaggaaagcggaaccgcacatatcgttctcgcagacggcgacaacagcatcatcgtcgtcaaaggggcaaatgaccacgtcactcctgaatatgttcaaaaagcgctgcctgcaattaaacaggctgatatcattctgattcagcaagaaattccggaggaaaccgtcgattatgtcagcggactgtgcagctctctcggcattcctctcctgctgaatccggcaccagcccgtccgctacgcccggaaacggtcgaacacgcggcctacatcacgccaaacgagcatgaagcttcggtactgtttcagggcatgtcccgggaggaaacgttaaagcgctatccggagaagctgttcatcacagaagggaaaaacggcgtccgctatcacaatggtctggaagaacgtgtcgttccttcattccctgtcaatgcgattgatacgacgggcgccggagacaccttcaatgcgggatttgccgtcgcgctttccgaaggacaaagcatcgaatctgccttgcgctttgcgaaccgggcggcttccctgtcggttctgaaattcggcgcacaaggcggcatgccaaaacgggatgaagtggagcgtgaactgtcatgaaaaaacacggaatattaaacagccatatcgcaaaattgctggccgatctcgggcataccgataccatcgtcatcgcggacgccggtctgcccgttccgcccggcgtccccaaaatcgatctcgcactgacattgggtacgcccggatttcgagaggttacaaagctcatcgccgatgaaatggttgtcgaaaaagtgacggcagcccaagaaatagaaagcgtcaatcccggtcaagccgcatttttaaaagcggaattttcaaaccaaaagattgactatatcccgcacgaagcattcaaaaaggcaacgagccaggcgaaagcggtcattcgcacaggggaagcaacgccttatgcaaattgcatcttgcacgcgggagtgatcttttagatgtttacattctacatctggaaagaagggatagcccatgcatattaaaatgaaggacatttttaaagcctttggccaaaaccaggtgctgtccggcgtttccttcgagcttcaagaaggtgaagtccacgctttaatgggagaaaacggcgccggaaagtcgacactcatgaatctgttgactggacttcacaagctggacagcggaacgatcgagatcgacggaaaagaaacgtatttttcagatccaaaggaagccgaacagaacggaatcgcctttatccatcaggagctgaacatttggcctgaaatgaccgttttggaaaatctgtttatcggcagagagctttcttccaaacttggatttttaaacaacaagaaaatgaaagcgctagcaaaagagcagcttgaaaggctcggtgtctcaatttctcttgaaaaagaagccggagactgttccgtcggccagcagcaaatgatcgaaatcgcaaaagcccttatgacagacgcgaaagtgatcatcatggatgaaccgacggcagcgttgacagaaagagaaattgaaaaactgttcggcgtcattagagcattaaagaaaaacggcgtctccatcgtctatatatcccaccgcatggaagaaatcttcacgatttgcgacaggatcacggtgatgcgcgatggaaaaacggtggacacgaaacggattcccgacaccgactttcatgaagtggtgaaaaagatggtcggacgggagctgaccgaacgctatcctgaaagacagccaaatccgggacgcgtcgtcctcgaagtcaagcaggcatccaaaaaaggagtcttccaaaatatcagcttttccgtccgctccggcgaaatcgtcgggatttcaggactgatgggtgccgggcgcaccgagctgatgagagcggttttcgggctcgatccgcttgactcgggagacattttcatcgaaggcaaaaaagcggcgctcaaaaaaccgagcgatgccgttcaaaagggaatcggctttattaccgagaaccgcaaggatgaaggacttgtgctcgacacgtccatcagagaaaatatcgcccttccgaatctcgccagcttttcgccgaaaggatggattgacaaaaaaagcgagcaggaatttgtcgatcttctgatcaagcggctgacgatcaaaacggaatcgccggaaacccacgcgcgaaacctttcaggaggaaaccagcaaaaagtggtcattgccaaatggatcggcatcggccctaaagtgctgattttggatgagccgaccagaggcgtcgatgtcggcgcgaaaagggagatttatcagctgatgaacgagctgacagaccgcggcgtcgcgatcgtcatggtctcttcagagctccccgagattctcgggatgagcgaccgcgtccttgtaatccatgaaggaacgctaagcggagagctatcaagaaatgatgccacgcaagaacgaattatgacactcgctacaggaggacggtaacatgaaaactcaaccggctgtgaaaaaaagccttaatgttgattctgtaatgcaaaagctcggtccgtttctcggcctgatcattctcgtcgtcatcgtatcattgttaaatccgagctttttagaaccgttaaatattttaaacttgttaagacaagtcgccattaatgcgctgatcgcgtttggcatgacctttgtcattttaaccggcggcatcgatctttccgtcggagcgattttggcgctgtcaagcgcattgatcgccggaatgatcgccggcggcatcgatcctgttttcgccgtcatcatcggctgcctgatcggagccctgctcggcttggtcaacgggctgttaatcacgaaaggtaaaatggccccgttcatcgcaacacttgccacaatgacgattttccgcggattgacgatggtttatacagacggcaatccgattacagggctcggcaaccactacggcttccagcttttcggacgcggttactttttaggcatccccgtccctgcgattacaatggcagccgcctttatcatcctctgggtgatccttcacaaaacgcctttcggccgccgcacatatgcaatcggcggaaatgaaaaagcggccttgatctcgggcattaaagttccgcgcgtcaaaatgatgatttattctcttgcaggcctattatccgcgttggctggagccatcttgacgtcacggctaaactcagcccagccgacggcaggcacttcctatgaactcgacgccatagccgcagtcgtattaggcggcacaagccttgccggaggaagaggacgaattgccggcacactcatcggcgtcctgatcatcggaacgttgaataacggcttgaacctgcttggcgtctcttcctttttccaaatggtcgtcaaaggtgtcgtcattttgatcgcagtcctgctggaccgcaagaaatccgcttaaggagggctatactgatgaaaaaaacattaacggttttcaccgcattggcgcttctgtttctgtccgcctgctcgctggagccgccggaatgggcaaagccgaataaagaaaaaggaacggatattaaaatcggtttatctgtctcaactttgaaaaatccgtttttcgtttcattaaagaacggagttgtcaaagaagccaaaaaacaagggatagaagtgattgtcgtcgatgcacaggacgattcggcaaagcagacgaatgatgtcgaagatcttctgcagcaaggcgttgacgctttattgatcaacccggcggactcctccgccatctcaactgcagtccaatcggccaattcgcttggcattccggtcgtcacccttgaccgctccgccgaaaacggaaaagtagaaacgctcgtcgcttcagataacgtaaaaggcggacaaatggcagcggactttattgtggagcagctcggcaaaggcgcaaaagtggctgagcttgaaggcgtccccggcgcatcggcaacaagggaacggggctcagggtttcataagaccgctgatgacaagctgaatgtgatcgccaagcaaacagccgactttgaccggacaaaagggttgaacgtcatggagaacctccttcaaggaaaccctgatattcaagcggttttcgcacataatgacgaaatggcgctcggcgcgattgaagcgatcagaagctcagggaaagagattcttgtcgtcggcttcgacggcaatgaagatgcggttaaagcggttcaggccggagacatgtcggcaacgatcgcccagcagcctgaattgatcggcaagctcgccgtacaagcggcccgcgatattttgaacggcaaaaaagttgaaaaaacgatacccgcaccgctcaaactggaaacgaaaaagtaactgtgaaatcagacctcttgatacatggaggtctgattttttttggccacctccataaaagcccttgccgcccggctcaaatggcatttttcaggataagcaaacacaagcgtccgggactgatcggcctgcaaaggaacatagacgatcctgactgaccctttccgcaaaacggcgcgccgaattccggtcctcatcatgcgcaccattgctgtgcaacatgtttaaggaaggttagcgaaagcaaaaaagcccccttttcaaagagggctttttcatttactcgggattgccttcggccgcttcaattccggctgcaagatcgtgtttattgaaatccgcttgaaagaaatcttgcgtattcggcaatctgaggttcatattgagtttttgagaaatttgcaccgtgcattcttcgatttcataatcgaaaacgtgtccgccgacattgcggtcttcatctataaagtgaagatggaagccggaaactgcgattccgttggcatattgcggtgtccaaaagccgacgatcgtccccgtaatatcattaaaatcaaagatcggctgtgattttaccgcatcaaccatcggcacatacggtttttcctgaagttcaactgttctcgttttgactttcttaaaggttccgtccatgcgaatcgcgtaaaacaggttttcactcggcatgatccgtttcatttcttcttcgaacgcctcaagcggcatccgctgcttgatttcgtgatagatatccggccggaagaaagccagcgagcaaaatggagaacaatcgcttccttgaactgggtaggcttttccatcggaacggagacggtaaaactcaccgtcaaaaccgatcagctcgccgtcgagccggttgaacgttccgatcccgaagtctccgtgctccttcgcttcggacatataaaaatccccgtcgtaaattccgtccaataaagataccatcgttgagacctgatagacttgatcgaggttcttatcaacgggctgaattattttttgtttgcttgcacttttcattttcctcttttcactcccttgattttgttcgttgtgactggacatgctgtgatcaagattgcttagaggcttctttattaaaatgttcctcaaatttttttggaaaacgctgatcggccaaatgaatgttgtcgctgtaatcgaccggaatatcaatgacaacaggcccctctgcatcaagaccagctttaagcacctctgccaattcgtcaggtgaattgacccttaaaccttttgcaccaaagctttcagcatattttacaatatcgattccgccgaagtcgactccggacgtccgcttgtatttcatctcctgctggaacgcaaccatatcgtatgtgctgtcattccagacaatgtgaacgatcggcgcttttaatctgaccgctgtctcaagctccatcgcggagaacaggaagcccccgtccccggaaacagacacgactttctgtcccggattgaccagcgttgctgcaatcgcccacggcaaagccaccccaagcgtctgcatgccgttggaaatcagcagtccatgcggacggtaggtgcggaaatatctagacatccaaatcgcatgggagccgatgtcgcaagtcaccgttatgtcatcgctcagcagttcacgcaaatcgcgaacgatttgcagcggatgaacaagatcagtttttgtttctttaggaggttcgctttgctcctccagtgctttcttcaagtaatcaaggacaggtgcaaaggactcgtcgatggaaaccggcagagaatcatgttcaatatggtttaacgtctctgcgatatcgccgatcaactcgatttcgggctgatagtcatgatcgatatcggcttgtatttcgtcaagatgaatcacgcttcgttcgccttttccattccaaaagaccggatcgtattcaatcggatcatagccgaccgtcaaaacgacatccgctttttccaatagcatgtctccgggctgattgcggaatagtccgatccggccgaagtactggtcttccaaatcgtgagacagcgtacccgctgcttggtatgtttcaacaaacggcagtttcactttccttagcagacgccgaaccgcttcaatcgcttcaggtcttccgcctttcatcccgacaagcacgacaggaaggttcgcattgtgaattttggcgatggccgcgctgatttgttcgtccgaagccgcgcccagcttcggcgccggcatggttttcaccggcttggcagttgccggaccggccgtaacgtcctgcggaaagctgagaaacgctgcgccagcctgtccagaagccgccgctctgaatgcattggttacagcctcaggtatgttgttcgcatcttccacttctgcgctatatttcgtaatcggctgaaacaacgccgcattatccatcgattgatgagtttttttgagacgatccgctctttttacagcacccgccagggcaacaaccggatctccttctgtattggctgttacaagaccggtcgctaaattagacgctcccggacctgaagtcaccaggcaaacaccgggctttccagtcaatcgtccgactgccgccgccataaatgctgcattctgctcgtgacggcaaacgatcaattcaggccccttgtctttcaatacgtcaaacaccgcatcgattttcgctcccggaataccgaaaacatgagtgacaccttgctgaatgagactatccaccacaagctctgctcctcttacagtaagagtttcatttttagcggctacattattcaaagccctcactcctccattttcattcatttacaatgaatttttaataaaattattgtattattaaatatacatcttgtggaaattgttttccaatacttctttgtcttacaattaatatgtaaaacgactgaaatcgcattcagaaaggaatgagtgattaatggagctgcgccatcttcgttattttatggttgttgccgaagaactgcatttcggaaaagcagctcttcggctgaacatgactcagcctccgctcagccagcagattaaacagctagaaagtgaaataggcgtcaccttgctgaagaggtcaaaaagagccgtcaggctgacggcggcaggcggggtctttttaaaacaaatcaaggaaggactttcccagattgatcaggccgtcgacatggctcagcggacggcccgcggggagctgggaagactcgtgatcggctttgtcggctccgcaacatacgagatcatgcctcccatcatcagggaataccgaaaccggttcccgtccgtgcagatcgatcttcgggagctttcaacccccaatcagatcgatgcactgctaaacgggcatattgacatcggggtgctgcatcccccgttgggaaacgacgaactgaagtcatacacggtaaaaaaaagccattgtgtccttgcacttccaaaacaccacccgttgacagaaaaagcccgggtacatttgaaggatcttgaagaagaatcgctgatcgtcattgccaaagaagcgtggccctctttatacacggaattcaatttcttgtgtgaaaaagccggatttatccccaacatcgcccaggaagctacagaataccaaatggtgatcggcctcgtatcggccggaatgggaatcgccgtcgtgcctacggcggctaaacgattatttaaccttgatgttgtatacaaagaaatcgaagactttccccttcgcgccgaatggattaccgcacatcgaaaggacaaccgcaatccggcacttaagcatttcatcgaaatctcagatcaacactcatagccgtatagaaaaaaccccgtggacaaatcctccttgttcacggggttttttcctcatatagacgtttgcaagttttgaaaacgcagttaaatgccgattgctgccccatcgcttctcggatcgctcccccctctcaggaagccttgatcgtcaatctcaatgattccggcatgacccatcaccccgtcaaattcaccgacaacggttacatgatgcccatgctttcgcagttttgcaatcacttcaggcgccactctgctttctattcttacaccttccacccgctctccccatgttctgccccatacccatctcggttcatgaacagctgtttgcggatccatcccgtaatctaccattctcgtaataagagccgtctgcgtctgcggctgtccttctcccccttgcccttgcgttccgtaaaggaatttcggcttgccgcctctaaacgccatggcgggcatcagcgtatgaaaagttctttttcccggctccagcgtattgacatggtcgggatcaagcgagaaaaacgcccctctgttctgcaaaatgacgccggtatctccagctgtcacacctgagccgaattcgaaatacaaactttgaataaacgaaacagcattcccgtcttcatctactgctgctgcataagatgtatcgctgccgagcggccggctctccgcctgaagcgccggcagtccgatttttgcggccagctcccgggcatactctttgtccagcaggcgtccaagcggaatctgtgagaattccgggtcagtcaatactttgttgcagtcggaaaaacttaatttcaatgcttcgataagcagatgataatactcgaaagaaccgtgctcgatcatgccaaagtcgtagttttccaaaatgttcaatgtcataagaccggtaaatccttgtgaattcggaggcatttgatagatggcatatcctctgtatgtggaggaaagcggagacacccattcccctcgatgcagcccgaaatcttcaaggttcaagatgcccccgttgttttggagataggctgctaaagcttgggcaatttcccctttataaaaggtgtctcttcctttctcagcgatcaacgtcaaagtgcgcgcgagctctttctgcacaaaacgctcacctggagagggcggttttcctcccggaagataaatatctgcagtgatcggcatacaggaaagccattcagcgtttttcaccgtgttttgacattgatcaggcgagaccgggaaccccttttctgcatacataatcgccggcttcagcacctctcgaagcgatagacggccgtacgcagccagtatttcggcccagctgtccaccatccccggcacggtaatcgcactccttgggcccctgaccggaatggcgcgctctcctttatactgatcccggtccgctttccgccccgaccgcccgctgccattgtaccctttgatctccccgcttccattgtgatacatcagccaaaaggcatcccctccgagtcctgtcatatgcggatagacaacagctaggcacgcgcttactgcaacagcggcgtcaaacgcgttcccccccttctccatgatgatgctgcctgcaagcgaagcgagataatgaggactgacaaccatttgtttcgaaccgatcttcagcttctccatagctcattccttcctttcaagcattcatttgtcctttgaagtatagtggcccgttaaaagaggcgctactttcagggaagaaaaactaacgcccttttttcaataagtattaaaaaaacgttaaaatgattcatatcgaaacccttattatgatacaatttacaaaatgttcatttatagtgtgattgacaagcaatttcgaatgataatgaccaaacagaaaggaagggatatttgtgagcctcgactaccatatgccaaatttaattctcgatgaaacggataaaaaaatcctttcgatcttgcatgaggaaggaagaatctcttatacggatttaggaaagcgtgtgggactctcaagagttgccgtacagacgcggatcaacaacttgattgaagaaggcatcattgaaaaattcacagccgtcatcaatccagtcaaggtcgggattcacgtatcggtgtttttcaacgttgaagtcgaaccccaatatttagaggctgttgccgttgctttggaaaaggagcccgccgtgacaagcctctatcatatgacagggccgagcaagctgcatatgcacggcattttcgcaaatgatcaggagatggaggaatttttgacgaagcgcctgtaccccctgaaaggcgtggtgagcgtcgactgccagatgctgattaaacgttataagagccgaatgggaatgaagctttaactgaataggaggaaacgcaaaatgaagcacccttaccgggaactgatcatcgcaatgacaagaacgggaatattgggctttggcggcggcccatctgttatcccgctgatccgtcatgaagccgtttctaagttcaaatggatcgatgatgatgaattcggggaaattttggcgattgccaatgcgctgcccgggccgatcgctacgaaaatgtcggcatatttaggtcataaagtaaaaggcgttcctggtgctgtcgttgctacagcagcccatatcatgccgacatgcgccgcgatggccgccttgttcgcagccgttaatgtgctcagccactcaaaaatcgtaagcggcatgatcggcgctgtcacccctgtcatcgccgtcatgctcggcatcatggcttacgaatttgggcaaaaagcattgaaaggcttcggcttgctgaccggcgtgcttttctttattcttgcgtttttgggtcttcaagtgttttccatccaccccggcatcattgtcatcctgtttttaacgtatggcgcgttccattttaaattaaaaagaaaagcggcccgagaaaaggataaaggagtgtccgcttcatgatcatcttttatctgttttgggccttctttattgcaaacttattgggctacggaggcgggccagcttcaattccgcttaattttgaagaagttgttcagcattttcactggctgtcaaaagaggaattttcaaacatgcttgcgcttgcaaatgcgctgccaggcccgatcgccacaaaaattgcagcttatgtcggctacagcgtgctcggatggcccggtgttttcattgctcttgccgcaactgtgcttccctcggccatcgcgctcgttttgctgctcaagctgatcggccgctaccgccagtcgcaggtcgtcaaaggaatgaccttgtcggttcagccggttatagccgtgatgatgcttcttttaacatgggaaatcagcggcgacgcgatccattcgatcggcatggttcaatcacttgtcatcgcgctgatctctttagtcgccttgacgaagttccgcgtccatccggctttcctgatcgtggcggccttcgcttacggcgggcttgtcattccgctgctgtagagagggacgtccggccgctttttatcaaatgacattaaaaatcagcgccgcataaccggtgctgacattttggctggggggcctttgtgaacaactttcacagcaggcccaacagctttttctttttgacgggacgcggtgtttctttatgaatctcccggttttccaggagcaggcccgcgttttctgtaaacacgttcaagaaatcgcggccgtaatcgttttctactgtatcaaaaaagaaagatcgggtcgtgaggttgtgggcgtctgatgcgataaagtggatgaggttcgcttcaagaaagcggcgggcgagccgtttgacgcttctgccgaaacggcctgcaagacttgaacatgtcagctgggcgcaggcgccgtttttgacgaggcggtacagcagatcgggattctccatcaattcaaggttccgctcggggtgtgcgatgatcggaatgtaaccatttaattggagatcgaacagcaccttttcggcataacgcgggacatggtggtaaggaagttcaatcagcaaatactttgtgccggcgaggctgagcagtctgccgcgctcaagatcgcgcttcaattcgccgtacaggcggatttcctgcccgggggtaatgagaaccgggatgttttccttttgcattctcgtctttaaacccgaaacagctgcaaggatggcttcttttggatgttcgtatacaccgtttcggtggtgcggtgtggcgataatcgtatgaatcccctggagggcggcttgtttagccatttctaaactgtcattcatacatgctgctccatcatcaacgcccgcaagaatgtggcaatgaatatcgatcatatgcgacctccccgtgttttcccgtttcagaatgtatggtctttgccgacaaagctttccagcttcctggcctgtccttttttcggttttacatacagaatatttcccaacacgtgaacattcagatctttttcgatgtcttcttcatttcgaacggtatttttcaaaagctcgagcaaaaatgctagcccagcgccaaacagaaggccgaaccctgtaaaaagagcgatgttgaacttcttgttcgggctgacgggaacaggtgaatgatcgggattggctttcgcaacaaggctgatttcggcattttcacccataatatcgccaatgtctctttgaaatacggcggcgactgtattcgcgatatccgccgccttggaataatccttgtcagtcgcggagatactgacaatctgcgattcattttcgctgataaccgtgattttttgcttcaggtcttcagccgtttccgaaaggttaagttcgtctttaaccttatttaaaatgatcgggcttttcataatgacgttgtatgtgttgataagttcaaggttggtctggatgtcggtgaagttcgacgtttgacggccgttgatgaggatttgggcggatgcctgatagacgggtttgagccaataaaagttgacggcagcgctggacaaagcagccgcaatggtgatcagtgcgaccagaacgaatctttttttcaaaacgatgaacacatctttaaagccgatatgatctctcataaaagcccccttctacgattcgcgtatttatttaaattttcagcaaattaaacacctacctttgattatacatggttatttcgtttccgaaagaaatgaatcctgacaaataacgggagataccggggaaaccgcgtctttatatggtattaaatatcgacttttgcaggatctgcgcacttcttgctgaacgaaaaagtgtgcaaaccgcagtttgcacaccttttacgtcgtatatccatttttgatatgaagaatgagatcttcaagaagttctttcgtcgttatgtctttcgatttttcaccaacgtcatacgcatgcataagaattctcaaaaattcttcctgattcaattccttgtcatccatatccttttcctttcagcttccataaattaaaacatttctgattatatttcaaattatatgatgtaaagaatcgatttgccatagtctattacattattcgacagccatccgtttttatgtccttttcctgagaaaatcttttttggacggattgattaagctataatagagagattggaaactttttaaaagtcattcggttaggagcgatagacatgcttcaagacatgatctcaaaaacggttgtgatggatgcagctgaacagtttaagcatgtactgccgtgcacagaagaaaacattcagctcatgaaaaaagcccttattttatacagacaggattccgtctatcgggtcaagccgatgagcgggcatacggtcagcgcttacgtccaggacgttgtcccggtaaaggtcttcatcgacctcgccgacgttaaaaaaagcagctgttcctgccctgctcaaaacatgtgccgtcatgtgcttgccgtttacttatatctatatgcacaatatgatcgattgggaacatttacggagttttggaaggaagcgcaaaaacgccgcgaaaaccgggagattctcggacagcttcagcgcggaatgaagccccgcagccacacgctcgatcaatggacctcctttttcaatacggagttcagacgctgggaggagcatacgcctaaaaaccagcaaacgatgcaatacctttactacgggtatttttcagctttaaaaaagcggacgcctgcggagccggagctgaaaaaaatgtatcaaatccacgcggctcttgcgacatggcttgctatgcattcactcgtcgagaaagggcgcatcgatcctgaaaaagatttttactcgctgaatccttatatcgaacagctgatggatacgatctacagctcgatcgatgaactgaaaacatatgcgctatcgttctcccttgacccgtttttagaaaaaacccccggcgtgattcgggaactgctgctcaagaaagatattttccagtatgaaaggctgcggattttcggggagatctggagtgcgcttctatcccggccaaactggctgaagcgggagctcgatgtgctgaacaatctggagccttcgcctgaaatacaattcggcaggctgcatcttgaatttctgctgaaaaacgatgatgtgattcttgatcaagccggatcgttttcaccggagattcttccgtatacgtttcaatggctcagtgtcatgaccgccaaaaaggactggaagcgcctgaaaaaatggtatgaacaccttgagcagctggcggccggcttctgcagactggataaaccgtaccgggaaatacgcgatgtactaagcgaattcttcctgtttctaagcgattacagcaaaaacgcaaaagaagagcatgtatttgaacggtattgcaaagagtgccttccttatacatttactgaatacagccattttttatataacaaaaaccgctttacggagtggatggagatccacagccttgtcggtttttcaatctctgagatagggcagaacgccttgaaagacattgcggcagcggctcctgaagcattgatcccttcctatcacagagaaatttccgggctggttgaacaaaaaaaccgctcaagctacaaagaagccgtcaaacaattaaaaaagctgcgcaccctttataaaaaagcgaaaaaacaggatgtctggaaccggtttatggagcagttttcagcccgctataaacggctgagagccttccaggaggagcttaagaaaggaaagttgatcgatggcgagtcttaaggaaatcgtaatacatgtcgaacagtcagaagactatacatttattttatcttgtcatgacggggatcatcagtttcttacgcgaaatgaaatggaaaggcatttgtttcagtggcacgaatcgtctttttacggaacatttctcgaggaagccggtttagatacccctgcggttctgctgtccccgtggatggcggtcgaatttctcggcaaaaactcatttaattcattcagcgacatcatccttactgaggaaactgaacctttgatgaaaacggcttccaccatttatgagtttatcgcagatgaagactttcttcccgactatgaagcatggaagcaggaaatgctgcgctggaaagataaagaagggattttggaaggctatacagccgaatggttttcacacgctgtcgaagactacatcaactacaatgacgaattaaaagcaaaatgggaatcgattgtcgcacattcccccgcagtcaccacatttcagggacattttcttgatgaagacgattttcttgaaacgattggctggcatgaaaaccctgtgccgtttaccgtcggactccgcttaaatgaacctgactttgacggagacgattggaaaatcgaactgtttttgcgcgacaaaaaaagcggagccattcagttctttgaaggcttgaacaggctgaaaaaatcgtggcaggcatacgctgataaaatcgaccgagaacaagacaggttccgccaaatcgtgccctggctgacgatcgaatcggggacgtcgcttttaacggaagaggaagcatggatcttcctgtccgaagctagcgaaacacttgtcagcatggggattgaaattctgctgccgtcatggtggcaaatcgtgagagacagcaatatgctgctgaaagcaaaagtgtcatcggctccccgcggcgagtcttttgtcggaatgaatgcattgatggacttcaactggcgttttgccaccaatggaattgaactcacagaggaagaattcgagcagcttgtcgccaataaaagacggcttgtcaatatacgcgggcagtggatcaaaatcgacccgaattttatcaaacaaatgaaaaagctgatggagcgggcagaaacagaggggcttcatatgtctgacatcctggcgcgcgagctgacagagcggagcgaaacccgcgaggatgatgatctgttcgatgcttccgcattcagcgatgtacggtttgaactgtcctatcagctgaaaaacatgatcagaaagctgagccagcgcgatgatctcccgtcatacccggtcagcaaatattttcacgggacgctcagagcttatcaggaagacggtttgaactggctgatctttctcagaaactgcggcttcggcgcctgcctggcagatgatatggggctcggaaagaccattcagatgatcgcctatttcgcctatttaaaagaacagggacaacaaacgccgtctcttatcattgcgccgacttccgtcctcgggaactggcagcgcgaactcgagaccttcgcgcccggcctgacggcagcgctccactacgggccaaaacgccctaaaggtgaagcgtttcagacatcttacaaagatgcggatatcgtcttgacgtcatacggcctcgcccaatccgactttgacgatctcagcagcgtcgcctggaactgcatctgccttgacgaggcccaaaacattaaaaatgcgcacacgaaacaatcccgttcaatcagaaagctgaaaggactgcatcatatcgcgctcagcgggactccgatggaaaaccgcctgacggagctgtggtcaatctacgatttcatgaacaaaggctatctcggaagccttggcagcttccataagcgttttgtcctgccaatcgaaaaagaccgcgacgaaaaacggatcgaacagcttcagcagctgatcaaaccgtttttattaagacggacaaagcaggacaaagaagtcgcgctcaatctgcctgagaaacaggaggaaaaagagttcgttccgctctccgcagaacaggcttcactatatgaacagcttgtcaaagatacgtttgaacatatgtcaagcctcgccggaatgcagcgcaaagctctaatcttaagcatgctcggcaagctcaaacaaatctgcggccaccctgccctttacttaaaagagaccgggagcgagctccttaacggaaggtcagtcaagctcgaaaaactgctggagctgacgaagacgattcgcgaaagcgatgaaagctgcttgattttcacccaatatctcgggatgggagatatgatgaagcgcctgctcgagaagtcattcggcgaaccggtcaagtttctgaacggcagcttatccaagcttgaacgggacaaaatggtggagcagtttcaaaacaaggaatttccgattttgatcttatcattaaaagccgggggcacaggcctcaatttgacggccgccaatcacgtcatccattatgacagatggtggaatcccgcggttgaaaatcaagcgacagaccgcgcctacagaattggacagaaacggttcgtccacgttcataaactgatcaccaccggcacaattgaagaaaaaatcgaccaaatgctcgaatcgaagcaatcgctgaacgatcaaatcatccaaagcgaaaattggatcaccgagctttctgagcatgaacttgaggagttatttaccctgaacgcttcggctattacaggttaaataaaacagctgtctgcgatagacagctgttttttgtgtttatgccccttaatgacagtcccaattaaaaaatcccgcgctgattgttcgaattgcccgcggaatcgggccattttttcgggtagttggaacggctgtttcattcttatcactctccttttaagcgggtgatcctattatttcaaattcaatcaatagttaaataggaatagtaacaaaaacaaccatcgccaacaaagaatcaaaagtcataatcatcgaggtcaaaccatattaaaaaaggccgccgacaatgtcggcggcccgcggaccaataacatccgctgcttaaccgcactccttcaatcgttacgctgccgtgtaccggcatcacgccgatttgaaaggatgtacgaattaaaccggtttgacttgctgttcaatcagctgatgcaggatgtgagcaacgccattttcatcattagtgagcgtcacctcatcagccatctctttaatgtctccgcgcgcattgcccatggcaaagcttttccccgcgatcttcagcatcgaaaaatcattgaggctgtctccaacggcagctgtttcctgaagggaaatgccgagcttgtgtgaaagcttctccaatgccagcccttttgacgcctgaagatgctcaatttcaaagttgtgctcggctgaagtgacaagcgtaatatcttgtgcatcttcaaattgcctccagcccgtttccagcttttccttatgaaaagaaaaagctaatatgttatatacattaacatcctttccggctaaaaacagatcggtataggagctgatgtacgcgtatccgttttggctgagctgctgttcagccgcgagttccagccttgataggtctgcctcaggatttgcgcttttcaagcggtccagctcaatgtcaagcagctcgcggccgttttgcggcgtgaagattgcttcatcgctgaacacctcataatagtagttattttcttcaagccatcgaagaattccttctgcccgtttccgatcaagcggcaccgaatggtaaaggctgccttcaggatcatgaatcaccgctccgttggcactgataatccatgttttaatacctgtcggctcaaatatcgtttgaacatcaaaggatgctctccccgtggcaactactacttcaatcccgtgttcccgcgcttttttaatcgcatcgatattttcctttgagatcttgctttcactgtttaacagcgtcccgtctaaatcgaccgcaatcattttcatctgctgtattcccccttaagtatcgtgatgttcagccacaagcagctccacatcgtgttcatcaagcagcttctgaaacggtttcgacggcagccggtctgtaatgagaaggtcaatgtcactgagttcagcgtatcggtaaaaatccgttctcccgattttcgaatggtcggcaagcgctatgacttgcttcgcttgggaaatcattttccgcttcaccattccgtcctcctcatgggcgattgtaagcccatgttcagaaacccccaccacgccgatcagcgctttatcaacatgatagcatgacagcttttcaatgacagaggcgccgtacaaaaaccggtgctctttttgaagctttcctccaagcaggcggatgtcagccccttttcttgaggaaagaacgtccgcaaggttaatcgaattggtgatgatcgtgcaattgacatccggcaaatgctctgcgcatgattggactgtcgtggaagcgtccaaaataatgcggtcgccttctctgattaaagaagcggctgcttttccgatcatgcttttttcttcggaaaccatgcccagcctgcccgaatagtctttgacctcatcatgaacggtgggcagaatcgccccgccccttgtcctgataatggcgccttgctcttgcagtttaaccagatcccgccttgccgtatctcttgaaactccgaataaagaacaaatttgttcaacggaaatccgtttatgctcttttaaatagtcgatgatggaaattagcctttcctcttggtacactggatcattccttctttgcgcaagtaaagttcatcatttataagtgattataagcaattacgccgaataaatcaagagtatataagtaatgataagcaaaaataaagcctgaggccggtttcccgtccctcaggctcgtactttaaaatgaaaatgttccatattgagagtgccaaatctcacgaaacgcatggatatcacgatctacagccggatgatcagccaaacggcttataagctcagggctgattgtcgcctcatggctccccgcttccatgacggcaagaatttgacggttatgtttaaagcttgccgcaagcactttgcaatttaaacagtatgtgttgaataagccgacaatcgttttgacaacgccagcgccattaccatactcttgatcaatgcgattgacatacggcgcgacataggaggcgccggcttttgccgccagtacagcctgtgcagcggtataaaccgttgtcccggtggtctggatattttcagccgcaagctttctgatcgcgtaaagcccttgagtcgtcaccggaattttcacagacacgtttccatctagccagttatagagtgccttcgcctgatcgaccatatcccgccaatggtcggcgatcacttgggcatggagaggcagatgctcgggaagaagccgccgaatatcttgaatctgctgtttaaaaggcttgttctcccttgcgatcagtgccgggtttgtcgtgacgccgccagcgggaaatgaatcaagcaatctttcaatctccggtatatgcgctgaatcaatcagcatgttcatcatcgcgtccccctcttgttttaatgcatgacctgccccccggttacattgatcgattgacccgtcatataagatgcttggtcagaggcgtaaaataagatggcattggcgatgtcatcatacgtacagccccgtcctagaggcactttttcggtgtacacgcgctctacttcgctctctggaatgccgagctttttcgcgtattgcgggatcaagctttggaacatcggcgattttaacaagtttcccggcataatgctgttcacccgaatgttgtgttcggcaagatcaagcgcgaggctttgcgtgagaccgacccctccaaatttagaagctgaataagctgtattatgcttgctgccgacttttcccgatttggaattgatttgaatgattgacccgcttccctgctcaatcatgacctttgacgtttccctcgcgcaaagaaaatacccggtcaaattgacctcgatggtccgttcccagtcttcaagttcaaaatccgtgattttattgcttttggcgattcccgcactgtacaccatcacatcgattttattgaattcgtccgtgaccctgccgatcatttttttcacatcggcttcctttgtaaaatccgcttgaatccacagcgatttgaccccgtattgaccggctgcatgatctgccgtcctttcggcgttctcgccgttgatgtctgcgaccgcgatgtcatatcccgcctctgccatccggtaggacagcgcttctccgagactttggccgccgccgcatatcaatgccacttttcctttattcatctccatattgcacccgctccttatgagaatcttttaacttgaatacagtctcctgctgaaacctccggcagttgttcttttcgttcaaggtacagtgttcccggcagttcggctgaaactgatccgtcaaattttagcgtaatatgcccgagattcgccaagttttgacgaacggctccgccaacggctgtaattttgtaggactcgccgcccagtatgagctcatcgccttcattgaagtcgccttctacaggctttatatcaattgataaacaataatctttcaattcatccggagcaccttcaccaaataatatgagcatcttttcatctgaaaacgccgctgcttgagctccgattctgtttatttttgtttcataaagcatgaccattattctccctccttaagaaaaccctcagctgtcatacatgccaaagctggccagccaagcaataaaaacggttggcgcccccgtgagaaaacgcgaatacagcaccgacggcaccccgacttcaaccgtttcgacttccgcttccgcaagacccagaccgactggaacaaagtcggcagcggcttgtgaattgattgcaaataacgcaggcagcgccaaattcggcggaatgtttcctttgccaatctcaacgccgatcagagaaccgacaacttgtgcaatcaccgcccccggtccaaggaacggggaaagcagtggaaatgaacaaacaagcgagattagtagcaacccgggcagtgagcctgcaaatggtgataaatatttggcaaaaatgtctccgatgcctgactctttaatgatgccgatcaatagagccacaaaagccatgaacggaagaattgttttgataacggtttcaatcgcttcccgtccagcttgataaaatgtgctgacgatcgatcccatggccatcccgattttcgccatcatccctttcggcgactgctgttcactaatctttttctctgtgctataatggttttgtttattttgtatttgtttttcttctggaatattagactgttcaggctcctccacagctcccagcagtttaatattctctttttttactccggaaacatatatatcttctgtaatatgggcggcaagcggcccgcttttcccggtcgccatcacattgatcgtcggaattcgcttttgcgggtaaagtccgcagcgcagcgtccctccgcagtcgatgatcacagcggccatttcgctttcgggtactgtcgttttaaagccgtcgaccagggtgcaccccgtcagctcagctaaatgatccgcaaaatcgggtttgtttccgccggtgacgtacacgattttatttctctcttcatcaggcgtgatcaccagaggtccgccaaaccctccaggcccttttgaaacttcaaccgaacgataggaactcatctcctaaaccgcctttcttatttaagatcaatcgaatctttcaaggcaatgccctgctgtttcgcgacataagccgttgtcatatccgttacccagcccctgagaaagtttgtcacaatcccgactaaaagatagcggagagcaagctccgtcgtttcatgcccgagcgttgtaatccctgcggcaatcccaaggaaaacaaacagctcgcccggattcacgtgtgggaaaagtccgttatgcgtgtggcacgaataggatgcagccgcataatagctcggtttgtatttttcaggcaagaacctgccaagcgacagcgtcattggatttgcgagcatgaacgtaccgatgacaggcaaaaccatgtatctggtcaatggattttttcccgacttcctcgcaagcgcttctacgcgcttttctcctatcaggcgtatcagagcattcatggcgacaagcagcataatcaataaaggaacgatgtctgtaagcataccgacaaacacttctccgccatgcctgaataagtccataaacttttccgcaagccatgttacgtttttcatatttcacctctttttttgatttgaaagctcatcagtttttgaagccgtgttttcttctgcggaacatcaccccctttcgtgatgatgtcgaatgttctcaaggcatcttcaattgcaagacgtgtgaggcggtcgtgccgggcaagctccgcttgtccgatcttcagcaaatactttccttcaaacccttttaaaggtctgattcttgaaaagacggtgacaccttgcatttttgatgccttcaaaattttgttgcgtttgtcgatgacaaacaggacgaccgttccggctctgagtaagccggtcttccttccgaccgcgactctccctatacgcctgtacgcggcgaacgttcgattgaaatgcctgatttgccaaaaacctaaaacgctctggagaagccatgcagctccaagggcgatgataaagtaaatgatcatgattgatttctcacctcctcggcaatttctctggctgtttcggcagttgtcactaaaacattaatatagcggccttttgcagccccgataatcgaaggaactttttcatgggattcggcaagacctatggaatattccaaatcctttaacctgttgatgtctatcgcgatggttctgtcatgaatctctgtttctactaaagctcccgaacgatcaaagaaacgcgagcatatatctccgactgcatgtttttcttcaaggcgctcgatatcctgatcgccgtaaaatccggtccagatcatatttgaagaactaagcggcgccccgattccgacggctgccacagtaaggccgttccacagcctttctatttttttgaaatagtgggacttgacgatttcctccttcgtttcttttttttcgacaacggctgccgcatctatgaagtaaggcgtgcctccaaagtcacccgcaatgctgtagacgatgctgttcacgtgatatttcgtatccatggcgcccggaccgccgaccagcggcacgaatgaagcgctccgttttttgacgccgtgaaactccccgatcattcccgccatcgtcgtcccccatgcgaagcctaccgtatccccgtctttcacgactcgttttaagatttcggctccggctttgccgacgagtttcttcttgtcttcagctgtttgttccggttttgcatcacatatgtacacttctttaagcccgagcagctgttcgagctcccgttccaaatcatagtgtgtcccgacatggtcatcgatcgtgattttaacgattcctgcctcacgcgcttttttcagcatacgtccgacggttgttctgtatatccctgttgcttttgcaatctggctctgtgtcatatcctcttcgtagtacattttgcagactttgatcagaaggcgtttatcatccctcatttccataagatcaccctttacctttgcgcatttgtgcaaacattggtcatttgttgttgtattcgcttacattatacatacggaatttttggacgtcaatttaaatttgtctattttttgtctaaaataaaaaaaccggtcattcaaaaccggccataaaaggggataaacaaggggatattgattgattctttttgagaaaggagtttatagaaggaatcttaggtttaagcatcagccggctcatgcgctttccggctttctcccaaaaatctgactgaccgggcgacaacttctgtaataaaggtgcgttcgccttctgaattgacgtattggcgggtctggattcttccgctcagcccgatgatggagcctttttcgcaatattcggctgtgttcacggcagttttgcgccatagagtgcaattgacaaagtccgcttctacttcgcctgctgcgttcttgaaaggcctgctgacagccagcgtcacatttgcaacagggacaccgtcagatgtataccgcagttcgggatcttttgtcaaacgcccgacgagcatgatctcattaaacatttcgtccctcccttcctgttcgggtatccccagtttataagagaacagattttaagcaaaatcctcataaaagaaaaataacccggaaaaaaacccgggctcatgtcataatttttgcttttttcttccactaatcataaaaatcatttcatttttatttgagaaatacgtatttttcagaaactgaaaaaaaacaggagatgacagccaccgctctgagtatacgcggacatatgagcccccgtcccaagcatacagacggaatgacaactctttctgtttaagcgttacttgaaattcgtatatttccattccgtccttcgtttcatagcgaaacatgatgccttcatttgcatatgtgctgatttcgtgctttttgttaccggctgaaaagcaaatcataggcatatattgacggcagtcagcagctgaattgcttgcgatcacaaatacttcctttaagtaaaaatggttcataagtcacctcctgctcaatatcacctaaagtataaataaaaataaagcattataaaatactttttgcaaaatttaaaatatgaatatgctcctattgcagaaacaaaccagggtcaagagttctcccaagcgaatgtgctataatggttatacaactatggaagcttgtgaggtgatactaatgaaaacctttaggcttattgatttaaaaattgtccgccaggatgacacttcaaagcggcttgaggagttcccgctgatcgacggccttatcattaataaggaagacggagaaaaccactggatggttgaagggctggtttctaaagaataccggtattttttcgaatatctccttcaggaaggcaaagaagtgaaagcatatgtaacgatcacgaaaaaaagcaaccgcccagcacagctgttagcgaaggtcaaaaacatcacggtgctcggcgagcatgtttccgtcttattggacggcaaaatggtcagctcaaagctgaggaaaggctccgacaagattttggaagatttaatgaaagaaggatattccggagatcggcttcttgaagcatttaagcaaaatatataaaaaaggctgtcttcgccggacagccttttcatttatagctctaagaacggtttgtctgctcttttaacaaatcccgtatttccttaagcaattcttcctgaggatcaggagcagctttttcttcttcggcatccttcttcttcagcttagagatatagcggataaatagaaaaatggaaaacgaaataataaagaaattgacgatcgactgaatgaatagcccatatttaatttcggcatcaacaaatgtgaacgacagcgcggaaaaatccaggcctccaagcagaagaccgaggagcggcatcatcaaatcattgacaagcgaagttacgatttttccaaaggcgcctccgatgatgacaccaattgcaagatcgattacatttccccgaatcgcaaaacttttaaattctttccacatgaatgatcaccttttcgctttcatgataaaaaaacaaatgggcttttacgaaaacccattgtgtttacattattcctgcttttcaccaagagaaaacatcaattcggcttcacacacgacttctccgtccacttttgcgactccttttcctttgccgatggaaccgcggaaacgaagcacttcaagctcaagatggagctgatcgcccggtttcacctgctttttgaagcggcagctgtcaattcccgcaaaaaacgcgagccttccgcggttttcttccttcatcaaaagcgccaccgcacctacttgcgcaagcgcttcaacaattaaaacaccaggcatcaccggataatccggaaagtgtccgttaaaaaactcttcatttactgtcacatttttataacccgcggcccgttttccttcctctacttctgtcacacggtctaccagcagaaagggatagcggtggggaatgatttctttaatttgctgagcatcaagcattgccttgacatctcctttttcgaaaaatatgtatagaatgatatgtcagtgccttattctgtacatctggaagtatattatgaaacggaatctttttcaacaaaagatgaggcacaaccggtttaaaacgatgaaagtgaaaataaaaagagcctgaaccaaacgtcgtttggccggctcctgttttgctgtgctaacgtactgaattgatcagccccatcatttgatcgcccatcgtgatggcgcgggaattcatttgatatgacctctgcgaagagatcagatcggtcatttccttcgatacgtcgacatttgatgattcaaggaatccctgttttagagaaatgtcctgccgcccggctccgttcaggttgataagagccgttgctctcaattcatcgctgacagaaaaaaggttgcttccttcttctgttagagcctgaggtttgacagcccggacgatccccaggttaaaacgcagtggcgcttctccctgattgtctgacgaaacggtgacacttcccgattcatcgactttgatgtgtttatagcgctggttgaagcggatggcatttccgttttcatcaaggacggcatgtccttctttcgtcacaagctgcatctggttggcgttccccgccgcaggcgtaaggtaaaatgccccgtctcttgtatattgcacttccccgccgacattgacctggaagtactgataaggagaagtcagtgcaatatcaagatcgcggcccgtctccttaaggcttccctgcttatgcgtcagccggtcggtcatgacggctccgacgccgaggcgaagtcctggcggcgtctttctgcttgcagctacttcattatttttctcgtttacctgttcaatctgctgcctgatcagctccgaaaagctcgtgtttttcgccttatatcccgttgtatcggtatttgcaagattatggctgatattatcaatttgtttttgcagttcaaacattgtgtttgaagccgtgatcatggatctaagcatcgtttttccacatcctccatttacgctgatcgcgatcggtcatttatccgatccttccaatctcattggccgccttttccatgcttttatcataagcctgaagaactttttggttggcttcaaacgagcggtaggcagcggtcatttccgtataggctctcgtcacgtcgacattcgaccgttcggtcatcccctgcttgacagaataagtgacttcaggattgccgactgcgcttggcagcgcctcaccgttttcagtacgatacagatcatcgccttctcttgctaaatttctcgtatcgagcgcgattctgacatcgatcctccccagattttggccgttttcagtcaccgttccgtcctcagcgacttgaaaattctcgcttcccaccgtgatcggccggttttccgttgaaaggacgagtcggccgtttattgtcaattgattattttcatttaaagaaaaacggctgcttcttgaatagcgtacatccccattttcaagccggaccgcgtagaaaagcgccgctttatcgtttgtttcgccgttgaccggaacttcggcttcgctgattgcaatatctgtcggctcattcgtgctttgcagatcgccttgagaaaattgaggcttcagttcctgcatataaacccctgtattgattgaaccgattggcgtctgtgttgaaaacgaacgcgaagcgctgccggctttgaaagaatcagactcaatccggctcaaaagcatttccgggaaagaacgtattgatccttggtcttctttatatcccggcgtatttgcattcgcgatattattcgtcagcatctctgtgcggcgctgctgggtgatcattgctgaagttgctgtataaagtccttttaacatcatttcacctcaaaataagtgtcatgctccagagtttcctatcgaaaaaacctcttttgcgaaatgcttgcaatttatatttgctaatacagaacgtttgttctataatggtattcaaacatactactctttttatcggcagccgttcagctcctttaaagcatttcacataaaaaaacctcattctcaaaaagaatgaggcttctgatcagctcagtttgcgcttgggaagcttgtccatgttatcaagcatgacacccgtaccgactgccacacaatccatcggattttcagcaacgagaacaggcactttcagctcttcggcaagaagctggtcaagaccgtttaacaatgcgccgcctcctgtaatgataacgcctctgtcgataatgtcggctgacagctcaggcggcgttctttcgagcacctgcttggcagcctgtacaatgacagatacagattcgcgcagcgcttcctccacctctttgctcgttaccgtaatggttctcggcaatcctgtgaccatgtcgcggccgcggatggaaatttcctcgtgacgtgcgtctgggaaaacagttgcgactttaatcttaatatcttcggctgtccgttcgcctatgagcagcttgtactcgcgtttgatgtagttcaagatttcaagatcaaacttgtccccagccattttaatagaagaggcggtgacaatatcgcccattgagatgactgcgatatctgtcgttccaccgccgatatcaactaccatgtttccgcttggctggaaaatatccattcccgctccgattgcggccaccttaggttcttcctccaaatatacatgctttccgccgcttttttcggcagcttctctaatggccttctgctccacagaagtaatatttgtcgggcagcaaatcagcatgcgcggctttgagaaaagaccttttacattcagcttgttaatgaaatgcttcagcatggcttctgttacttcaaaatcggcaatgacgccgtcttttaatggacgtatcgcaacaatattcccaggtgtacgtcctaccattctccttgcttcttcaccgacagcgagcactttcccattgtttttgtcaagagcaacgactgatggttcatttaagacaataccttttcctttgacatggatcagcacattcgctgtaccaaggtcaataccaatatcccttgcaaacatctatctatatcctcctcgaaatctgtttcacagcaatgtccacattctgccctaattatatattttatcataaatattagaaaaaaaagagagcttattaaagttcttcataaaatttttgtggctttttacggaggataccgggaaattctgataaacgctgctcgtttctgagccattattccttattgcacgggttctctttcaaagatttcctctttcttgtattttagttttgttgcttctccgccccgcaaatgtctgattgatttatgataatcaagaatttcttttacttcattggccaggtcaggattaatttcaggcagcctttctgtcaaatccttgtgaacggtacttttggaaacaccaaactccttcgctatcacacgaaccgtttttttcgtctccacgatgtacttccctatcttgattgttcgctctttgatgtaatcgtgcacaccactcgacctccctaaaatggatgtgagaagtgtgaaatgagatccgtcttgtgaaaaaattcgctatttgcgcagcttcttcgttttatgcttttccaagtagaattttgaaatactcccacgatccctcacctcaaacactctctttgttaggtttgtatcagtgtattagcatttaaatgggattatgctaaaaactcaaggaggacaaggggtttctcttataattttatttcgggcttcaaaaattttaactttacactaatcttgacttccggtaaaatgaataaagtttattatttacctaggtaactattttgaaggagtccgggaatggaacatatcaatcgaaagattattcaccagctcaatcaaagcactcggatggttgctaaaaaaacgaatgaacagctcgaagcgtacggcctttacggttcacagtggtcgatcctatattgtcttcacacctacggaccgatgacgcagaaagacatatggacttatttgcacgtcgaagcgccgactgtgacaagaaccgtcagccgcctcgaaaaaaacggctgggtcgaacggatacagggcgatgacaaacgggaaaaagtcgtcaagatgacagaagaagccaaaattaaatatgatgacattcaattaaaaatgaaagaatttgaagaggaaatgctttccgtatttgaagaacgggataaaaaaatattccaaaggctgttaagtcaattgttagaaggacaccaggaggagttgtagcctatgaagcaagctgaacccatttggaccagggattttatcatggtcgttttgattaatttgtttatattcgtctatttttacgcactattgaccgtgcttccggtctatgcgatgcaggagctcggcggctccgagtcagagggcggccttttgatcagcggcttcatgctgtccgcgatttttgcaaggccgttttcgggagctgttattgagcgttttggcaaaaagagaatggcactcatcagcgtcgtgctgtttactttggcatcatttctttatatcttcattcacgatatctacctgctgcttggcattcgctttttccaaggcatttggttcagcatcatcaccacggtgacgagtgcaattgcagccgatttaattccgccggcccgccgcggggaagggctgggctattttgctatgtcgatgaatttggcggttgtcatcggcccgtttatcgccttgaacctgctggataaaatgagtttttccgatctgtttattttattttcaggaatcgtcactgtagccatcctctgtacggcactggtgcggattcctaaaggaaacgacatccgttcagctgtgttcaggctgtcattttccaacatgtttgaaaagggcgcgattcggattgcaacggtcggcttgttcgtgtcgttttgttattcaagcgtgatttccttcatctctgtttatgccaaatccctcggccttattgaagcaagcagctatttctttatggtgttcgcggtgacaatgatgatcacgcggccgtttacgggaaaactgtatgataaagtcggcccgggagtcgtcatttatccgtccattatcattttttgcgccgggcttttcctgcttgcttttacaaacagcagtgcgatgcttttgctatccggagctgtcatcggcatcggctacggatctatcacaccgtgccttcagaccttggcgatccagtcttcgccgcctcaccggagcggctatgcaacagcgacttattttacgctgtttgataccggcatcgcagtcggatcctatgttttcgggttggttgtggcacaagccggtttttcaaacatttatttattctcaggcgttttcgtgctcatcaacctgtttctgtatacatggagccaaaaacctgcatccgcaaaggagaagcgggatatatcaatggctgaataagccgttcaacctcgccgggccgggaacgcccggctcttttcatgcaggctgatacagctcgatctgttatttaatgaaacttttgcaaaatgaaatacgtctcctaactgtctgcccaaaaattactactctattaaaaaggtgattttttgaactattggctttttacacgcattcatcaattagcaaaccacaacgacatcctggatggcgccatgattttgattacagaaaaagcgatttatatgtatgcgctcattttgcttttgatctggatattcggaaaccgttcttataaaataaccgttcttcaggccggtgtgacgggtattttcggattggcggcaaattatttgctgtcattggtttactatgagccgaggccatttgtcgctcatcatgtggacgtattgattcaccatgctgccgacgcctcatttcccagcgatcatacaaccggggcgttagccatttcgatcgctttttggctttatcatcggaaaattggaagctgcctgattgctttcgggttattgacgggcttttcccgtatttgggtcggacaccactaccctgttgacgtattgggcagcattttggtcgctttattcgtatcacttgttatgtttagattctccacgtatgtgcagccgctttttgaacggatcatttcactctatgaatcgatcttgcggaaattgcggaaagcggtatccagaacggtataagaaaacacccgaatcatgagattcgggtgtttttttatttccttaaccttttaaggcttcggttaacggcggaacaatttgttttttgcgcgatacaacgcctttcagtgtcgctgtgttgtctgccaatgtgacattgaacgctttttccactgcttgtgcagcttgtcctgaagcgacgacaaccgagtcgtttgttaaaatgtcagttacgacaaacacaaataaatccaaccctttttcagataccgcttttgcaagttctgcgtcaacttcctctttgcgggagagaacgtcgtttgtgtcgacagtgttaacctgcgcgatctctactttatggcttcccatcgtaaactcttttgcgtccagagaaagaagctgaggaatcgtctttgcgctcaaatcagctccggctttcagcatatctagtccatagctgtcagcatcaacgccggcaatcgcagccaattcttttgcagctttgacatcttcttccgtgcatgtcggggatttgaataagagggaatctgagatgatcgccgacagcatcagccccgcaatatcttttttaatttcaacgccgttttctttatagagcttgtttaagatcgttgccgtgcagcctacaggctctgcgcggtaatacagagggtcgctcgtttcaaagttggcgatccggtggtggtcgatgacttcaagcacgcgaacctgatccaagtcatcgacgctctgctggcgctcattatggtcaaccaaaatcacgctgtctgtttcattcgcgacagtgttcacaaggcggggtacttctgcattgaatttcttaagcgcgtattcggtttcgccgttgatttcgccgaggcggacaggctctgcgtccatgccgagctccttttttaattcggcatatgcaatcgctgaacaaatcgtatccgtatccggatttttgtggccaaaaataagtactttactcatgatataactccttactgttgtttttatagtaagcttacctgacaataaaaaaatctgcaaatctgtcacttattttaatatttacgaagtgttttgtcattttaaaaaataaaaaaagagccgttcggctctttttattctccatagtcaggtgtattgtggcttcgttttggagcgggcttcaagaccggtttttctccatatgcgacagggccgctctcatagtgaaattccgctccgtccggcgccttccctatcagccactcaaactgtgcgctttcttctccatccgaaaaattgtataaagagtgcgaaacttcttctttttcatattctggcggaacggtaccgggcacgatgacgccttctttttcttccagctctttgatcgcggcaatccactggttttggtgcatcgtatctcttgccaaaagaaaaccgagcatatcttgtacgcctttgtcatccgtcatttcgtacagccgtgcgacttgcagtctgccttgcgattcagcgttgacatttgcgcgcaggtcggccagaaggttgccgctcgctacaatatagcctgcattccaaggaacgccggtgctgttttcaggcatggcccccagacctgaaacgattgcgtgatgagggttcattccgcccataatggcgccgatgacaggatcgtctgctgctttttcctgctcgtaaaccggagcgtcttcaagcagccgtgcaatcatcgtcgcaatcatttcgacgtgtccgatttcttctgccgccgtatccatcagcaaatctttatacttttcatttccccgcgtattccacccttgaaaaaggtattgcatcgccacagatatttctccgtactggccgccgagtatctcctgcattttctttgcgaagacagggtcgggtctttcaggtttggcagggtactgcagcactttcgtatgcttgaacaaatcagatcactcctccgttttttgtatcctcgtttttgatttagccgaaaagggaaatcataaaaccgtacaacaggttcgggatgtgcttaaaacaggtcaaaattcgaaccaaaggagagctgttctatgataaaaaatacttctcaccgcccttttccactgcctgaaggaccgtggatgatgacgcaaacatggaatcatgtattatttgcccattgggctgtcgatcctgaagccattcgcggacaaataccggcggccttggaattggagacattcaacggaaaagcgtggatcggtatcttgccttttctgctgacaaatatgcgtccccgttttttgccgccctttcctttcatcagcagatttcccgagctgaatgtccggacatatgtagcatataaaggcgtcccgggcatttattttttcagtcttgacgccgcttcgcgcttggccgtcgccggcgcgcgctcaatgttccacttgccttatttttacgccgggatgcgctttgcacaacataaagaccgctttcagctgacaagcaggagaaaacgttcacaagcagagttttatgcagaatatcaaccggtttcggagcctttctcagctgataaaggaacgcttgaatactggcttgctgaaaggtaccgtttgtacaccacgcataaaaacgagctctattatgaagatatccaccattcagagtggcagctgcagcaggctgaagctgatatttttccgggtccgctcacaagcgcaaacgatctcacactcccagacaccgcgccccttcttcattatgcaaaaaggcagcacgtcttattttggccgctgaaaaagtgggaaagtgaagaaacataaaaaaggaagagctaaaaacgctcttccttcaacctgtttaagccggttttgaaatttcgcttaaagcttctcccgctttctcatccgcatgtgagacggagagatcccccaaagcaacgattccgacaagacggtcatcttcaacaatcggcagcctgcgaatttggtgttccgccatcagatcaccagcctcttcagcagacatatccgggcgccctgtcaccatctgtgtgctcatgatatcccgagcagccgcatctgtttcattttcagctacacatctgataacaatatcccggtctgaaacgatccccgtcaattttccgttctcgcagaccggaattgaacctacattgtaatcacgcatcttaccggcaatttccgcaatcggggcagaaggctcgcagcattcagcattggttgtcatgatgtccttcagtttcattcggaattcctcctttatgatggggttattatgtgcttttccgatataccgcgggcttaaacctatttaaaagagcccttccttttcatatatcgttttttatccctcaataaatcgccggtccagcctttctttttcaaataccaatacacaagggcggtcgaaacggcgattaaaataagcgaaaataaatagccgtactttaaagagagttcaggcatgacttcgaagttcattccccacagggcgccgaaagccgtcatcggcgtaaagatcgtcgtaaaaatcgtcagcgctttaaaaatttcattgcctctgtgggatgtcaccacttcctcggaatgaagcaaataattgatttcattcgcatactctttgatcaatgacatgcctctgtcgatttcgtaaaacgtcctgcgctgttcgatttcgtcaaacgatttggttaaaaaagtttctttaaggcccattgcaacctttttcatcgataaaattaaacttcttatgaccaggagttcgtgacgccgcttatgaatcagttcaatgatgcttttattgttgtcatgatgaaatccccaccttacttttccaaggtgaacttcaaagtgctcaagttccttcaaatacattctcatcagttcgcccagcaggaccaggaacacttcaggggcgtctttgcatcgctttaagtgttgatcgatcggccttctgtttgcctcttcaaattgcgagatatctaaattcattgtgaaaaaatagtctttcgttaagtaaaaatgaaatgctgtccggttttgttgaacttccgcttcctggtcgtaaatatatgaaccgtagatcgcttccttgccttgaacggcagcattgatatcaaggcaattgatgttggccgagggaacgccttgaaaccagtttcggcattccggccaatgatcgggctggatcagcccttgtgctgttgttttttcgtgagggccaagctgataccatgtccagccctctccctgaaaaactctcatacttgtctcctcctcttccggcccactcgttttatatttctttgcccgccctccgcgtaaataaacatgatgtttgccgcgctgcggcacgtggtatgaagctagtatgagtttttcatagaaaaggaggtggcgccttctttactgagaaggcggggcattggagttattgaagctgattgcagtagcaggattaatcgcatttacgggctttttcgtcgcggtcgaattcgccatcgtcaaagtaaggcggacaaagatcgaccaattgatcattcagaaaaaaaagggcgctcttgccgcaaaagaagtgacctcgcaccttgacgaatacttgtcagcctgccagcttggaatcaccgtgacggcattgggcttgggctggcttggtgaaccgacgatgcagaccttgctgcatccccttttctcaaaaatcggcttgaacgagtcgattacacatattctttcatttttggccgcttttttatcagttacttatctcaatgttgtcgtcggagagctggcgccaaaaacgatcgccattcaaaaagcggagaccgttacgctgctttttgcacagccgatgatctggttttatagaatcatgtttccttttatatggctgctcaatcattcagcccgcatgatcacaagtctgttcggcctgaagccgaccggtgaacacgaattggcctattcggaggaagaactgcgaacgcttttatctgaaagctatcgaagcggggagattaaccaaaatgaattgaaatatgtaaacaatatttttaaattcgacgaacgtacggcaaaagaaattatggtgccgcgcaatgaaatgaccgtcttatctcttgacgacagtttaaaaaaagcgaagcagcttatcaaagaaacgaagcacacccgcttccccgtcatggaggaagacaaagatcacatcaccggaatgatcaatataaaagaactgctgctggcggagcttgcaggggaattttctttagaaacaaaatcgctaaagccatatatccatccggttatccatgtgattgaaacgattcccgtctaccagctgttcgtcaaaatgcagaaagagcatacacatatggcgattctcgtagatgagtatggcggaacatcgggtcttgtgacggttgaggatattgtcgaggaaatcgtcggcgacattcgcgatgaattcgatactgaagaagtatctgctgttcagaaactcgaagatgaccattacatcctaaacgcgaaagtactggtcagcgacgtaaacgacctgcttggaattcatttatcagatgaggagattgatacaatcggcggctggatgctgacgcagaatattgagagcaagcccggaacgacgatcgaaagtgaaggataccgttttaaagtaaaagaaatggacggacatcgaatcgttgcagttgaggttgaaaaaaccgcttaatcccccttctgtcggatatttcagcctctccctgtccgcttttctccccaaaaaccatgtaaggaaatctgacatgttcatcatgatatctcccttttgtcactataatgaaagaaacagagatctgctctcaatctaaatgactacggaggaatgaaacatgcagatgggggatacagtatttatgttcttttgcgctttgctcgtgtggctgatgacgccgggcatcgctttattttacggaggccttgtaaggagcaaaaatgtgctcagcaccgttatgcacagtttatcttcaattgccatcgtttctatcatatggattttgttcggctattcactcgctttcgctcccggaaacccattgatcgggggtttggattggatcggactgcacggtgtcggttttgaacccaatgccgattattcggagacgatcccgcatacgctttatatgatgttccaattgacatttgccgtcctgacgactgcgattatttccggaagctttgcggagcgcatgcgctttccggcctttattcttttctcggtgctctgggcggttttcgtttattcgcctgtcgcccactgggtatggggcggaggctggcttgacgagctgggagctattgattttgccggcggaaacgtcgttcacatttcttccggggtagccggtctggtcgttgcgattgttctcggcaagcggaaaaatatgagcgacaccgcccctcacaacctccttctgaccctgctcggggcgactttgatctggttcggatggttcggtttcaatgtcggaagcgcgctgacgatcgatgaagtcgccatgaccgcttttatcaacacgaatacggctgcggccgcggggctgatcggctggattttggcagaatggctgattaataagaagccgacgatgctcggcgccgtctcgggagcgattgcgggactcgtcgcgattacgcctggcgcaggttttgtcacgccattctcatctgtatggatcgggcttatcggaggaatcgtctgtttctggggggtgttttcgctcaagaaaaaattcgggtacgatgatgcgctcgatgccttcggacttcacgggctcggcgggacatggggcggaatcgcgacaggtttgttcgcgacgacatctgtcaacgcagacggtgccaacgggcttttttacggagacatcagtctcctttggaaacagctgattgcgattgctgcaacatatttgtttgtcgcaatcgtcacatacgctattattaagatagtcagtatcttttttaaactccgtgcctcagaggatgaagaatcattgggcctcgatcttacgctgcacggcgaaaaagcgtatcaagattaatttgtcaggagtgatggtatgagcggtcaaatgtataaagtggaaattgtaacccgtcctacaaactttgaaaagctgaaaacggagctggccaaaatcggggtaacgtccattacgttttacaatgtacacggatgcggcctgcaaaaagggcatactgagctttaccgcggggtcaaacgcgaaagcaatgtgtatgaaaggttaaaagtcgaaatcgtcgtcagcaaagtgcctgtcgaaaaggtggccgagacggcgcaaaacgtcctgaaaaccggggaacccggtgacggcaagatcttcatatacgaaattaaaaacaccatcaacatccgcacaggcgaggaaggtcctgacgctttataaaaaagatcgaagctcccggctggagttaagccgggagcttttctaatgttacaaaacagcatcaataacaccgtatgccttcgcttcgtccgcatccataaagtaatcgcgttccatgtcggcttttagtttttcaatgggctggcccgttcgttcgtgaaagaagcgctcgattttttccctcagtttgatgatccgcttcgctgaaatctccatgtctgtcgcctgtcctttgacgccgccgagcggctgatggatcatgatttcgctgtttttgagtgcataccgtttgccttttgctccgccggcgaggagaatcgctcccatggaagcggccattccgacgcatatcgtgcggacatcaggcttcacataatccatcgtatccaaaattgcatatcccgcggaagttgatccgcccgggctgttgatatagatcgaaatgtctttttcattgtcttcagctgacaaaaacagcaattgggcggtgacccgattggcgaggtcatcgttgaattcagaaccgatcataatgatccggtcttttaaaagtctggaaaaaatatcgtacgatctttcaccggcagccgttttctcaatgacgtaaggaatggtgttcatagcatttttcctcctaggcagcgcacctcatcatgctgatgcaagacggctgtgaagcgtcgaaacgccatgtctgtttggcaaattcgagcaggtcatcggggttgtgatgcaatatcgcccgaacaagcagaccgatgtgttcgtcatccccgtccgccggctccttttgcagaacctccggagaaagcctttttaatcgctgacgcgatctaaataaaagcgacttgacggatgattcgggcttaccgagcgtctcggcgatttcgtgcagctgaaaggaaaacacatctttgagcagaaaaatcgttaattgcttcggtgttaaaataccggaaagctgtttcagcaggtgctcgaagtcatcggccgccttcatgcgctctgcccgcccgtcttccagattatcttcagacagaaagctttcgcgcttcctttttctgagcaggtcaatccatttatgctttgcaaccgtcttttgataagcatgtgacgcgtctgttcgattgatttccattaacttgaggattgtatcctggactaaatcctcggcatcccatttatcgcctgtcattctcaggcaatacttcatcagcgcttgctgttctaattcattcatgaatgcattcacactccttaaaagaggcctcttacttaataaacggctggctccgccgatttgatacgggtttttttatgattgtaacaaaaaaggcgcctatcgcatttgataggcgccctgagggaagcgtgccttatgactggcttgaatcgtcagactgggttccgtcttgattttctgacccttcagacgaatcttcccgcttggttttgtcgtcttttccatctgtttgatctttcgctttgtcttctgtttttgacttttcttcaacagaaggctgagcaggttctttcacttcagacgcttgttcctccattgctttttcaatgctggagaccggcttgtccatgaagttcagcgggtttagcgcaacaccgtctttgcggatttcaaaatgcacatggtttccgccttcttcattgtaaaggtttttgcctgcttttccgatgacttgattttgttcaatcttgtcaccttgtttgacgcttacttcagaaagagactgatacacagttgataaaccatcttcatgttcaacttcaacaacgtagcccagtacagggtcttttgcagctttgatgaccgtaccgcttagagatgcggaaacatcaaatgtttttccgtctttctcagccaagtcgatacctttgctcatgctgtacgtgttattatagtttacaagtgctgcttctttctcttctttagttgcgtcagtttcaaaaaactttttaacgacggaaacattttcagaatcagcaaccggcattgcgacattttcgactggtttgcctacttctaccgcatcatcccggttatcataggctgatttcttgccatcgtctgcaagctggtcttttacatcgttgttagaagccgattgataccatagaacggcggttaatacaacgacggcacttgtcaaatagatggccggaaatacccagcgtttacgaaaaaattgttgcagctttgtgattttggaagtacgattcttttcttcctctttcataactcatcacctcagcaacattctgaacacttttcagaaaatatatacatttacaaaaaacttttttcaatttattttgcaccggctgtttcgtttttatgtaaaaccgccctgaaaatctgaaaaatgaccggtatgcatgataacggaaaaaacgccgaagatataacatatgaagaaaggatagagagaatgaaattacgaatcgccaatcgggaagaccttcccgcagtagtcgatatttacaactccaccattgcgtcgcgaatggtgacggcagatacagaacccgtcacgcctgaagaaaggctgaactggtttttgagccataccgaagaaaggcctctttatattgcagaaaatgaaaaacgggatatcgtcggctggatcagctttgaatcattttacgggagacccgcctacgccaaaaccgccgaagtcagcatttaccttcatgaagaccaccgcggcaaaggggcgggttctgcggtgcttgaaaaagcgcttgaagctgctccaaagcttggaatccgttctttaatggcgtttattttcgctcacaatgaaccgagcatgaagcttttcaaaaaatacggcttcaccgagtggggacactttcccggaatcgccgagatggacggaatccggtacgacttaaaaatattaggaaaagaattgaatgaagcctgatcatcatgacaaaaaaagagctgtcatgcagctcttttttccatcaatcattcagccagcctgcgccttctgatctcttcttcatttaaaaattccaaaaagcttctcattacagtaaacggctcttctttgaccgcccgaacgtagcggcttttccgttcatcggaaagcacttcgcttgtttgcatccgttccaatatatacttcatcaccgattgctgaacatttcttttttggtatgacgactctctgaacagcgccatgccgaatgctgcacctgcggcagcgcagccgatttttatcattgaatcggttccataagctgcctgcccccaaaaagaggaaagataaacaaatgaagcaagaagcagcggaatcgcgataaaaagaaaaatcagccttttctttaagaacggcgccgccacgcgcttgaggttatccatttcctctttcataaaggccggcatttgatggaaacgttccatatccataatcaatccctcccgttttggttaaagaggcgttggtccgctaattaaatcacgctttttatatgtatatcgtaacttagatccaacatgttttacagttttttgccttcctccctttttctttagaaactttccggccgccgccccgtataacatgagatagttgcttgaaaggggagtaactgttataaatggaatgtataaaaacaaatccgtcttgtgaggttcaatatggatattattaaaaatatcagtatcacatcgatatttctcggttttatattagttttaaatacgcttttggcaatcgttgtgatctttagggaacgccgggatgcaagctcctcctgggcctggctcttggtgctcttctttattcccgttctcggctttatcctttatttgctcttcggccacaatttgagcaggaatcacctttttcaatgggaagaccgaaagaagatcgggattgaaaaaatattggaacagcagctgaccaagctgaaaaaccgcgagtttgaatttcgcaataaagcgacggcggacagcaaagacttgatttatatgcacattttgaataaccacgccgtttttacagaagacaatgcggtcgagctgttaacggacggacgccagaaattcgacaggctgcttcgcgatattgaaaacgccaaagaccatattcatcttcaatattatatttataaaggcgatgagatcggcaaaaagctccgggatgcgctcatcaaaaaagcaaaagaaggcgttgaagtccgcgttttgtatgatgaattaggatcaagaagcctcaggaaaagctttttcaaagagctgaaaaaagcgggaggatttgtcgaagtctttttcccgtcgcgctttaaatttatcaatttgcgcatgaattaccgcaaccaccgcaagctcgtcattatcgacggcgtcatcggctatgtcggaggatttaatgtcggagacgaatatctcggtctgaacccggcctttggctattggcgggacacgcacctcagaatcaaaggaacagcggtccactcgattcaaacgcgttttatcctggattggaatcaggcctcgcaccatcacgacattacatatatgccaaaccattttcctgacatcgactcccacggaaacatcggcatgcaaatcgtcaccagcggccccgattcagaatgggagcagattaaaaacggctatattaaaatgatatcaacggcaaagcggtccattcttattcagacgccttattttataccggacgcaagcctgctcgatgccctcaggatcgcttgtctgtccggcgttgacgtcaggatcatgattcctaacaaacccgaccatccgtttgtgtactgggcaacctattcttacatcggcgaacttttaaaagcaggcgcctccgtatttatttacgacaacggttttatccatgcgaaaacgattgtagtagatgaggaaatttcatcggtcggcacggcaaatattgatatgcgcagcttcaagctcaattttgaagtgaatgcatttttatatgatgaggaaattgcgagaagccttgtcctatcatttgaaaaagatctgcaagtgtcaagggagctgacctttgaggaatatttaaacagaagcaaatcgatccgcttcaaagaagccatttcgatcctgctgtcgccgattttatagcgcacaattcatgctgttaaaaaaatcctcccggaaacgggaggatttttgttttactcaccagaagctgccgcacctttgggtgctgaagcatgcttgtccatttgacggcctgtgtcagcgtccttgagcttgagtgcgatgaaaagcgcagccatgaggaaaccggctgcacagagcaaagctgtccggtaagctgataaatcaggctctatgcctgcgctgggctggctgagcacagcaaggacgcacgacatgacagcaactccaaaggcagatccgagccggttttgcacattaaacagcgttgttgcccggcccattgaggatgatgaaatgttggcaaaacaaacaacctgcgccgcaccaaccgcgtgccccaagaaaaagcccgctaaaaacagcagcagcctgagaagccaaagatttgacccatatccggtcaggctcagcagcccaaacagcacagcagcgcctaacagcgcaacggaaatgacccgcctcgggccaagctttgccaacgacctcggcatcagctgggacgccagcatcaagcctaatgcttcgggaaacgtaatcagcgcagtatctgtcgcagagtagccgagtgcttcctgacacaacagcggaaatatatagagcatgccaagcagtccgcctgctgtcagaagcgaaatgacgctcatcattccaaaaacccggtccttcaataagcgaagttcaatcaacggatgctcagccttcagttcgacaaaaacgaggattgcgaggagcatcattcccccggcccctgctgcaagcacatccggagagccgaatccacgcgcaggcccctggctgagtgcaaaaaccgccaacgccattcccggcgccgccaaaaggaatccaagccaatcaaatctgcccgcttccggctccaaatgttcatgaagatacaacaggccaaacagcagaatgatcattccgatcggaatattaatgtaaaaaatccagcgccatgacagctgatctgtcagaaacccgctgatgatcggcccaaccgcaggcgcgacggcaattggaagaacgaggactctcgaaattttggcccgttcatgcggaggaaacgtcctgaacaagatcgccattcccaccggcgtaatcaacccgccgccggccccctggatcacgcgaaatgcgtttaacgccgccagattgtcagcgattccgcataaggcggatgcagctgtaaatatcgaaagcgcggctaggaaaacacgctttgtcccaaagcggtccccaagccagccggctgcgggaagacagaccgccaagctgactaagtatccgatgttaactgtgcctgcagcagacggcaatgtttgaaattcggtcatgatggcaggcaatgccatgttgatgacactcgcatccatcgcagccataaacatggctgttacatatacaatgctgacaaccgtcctttgattgaacggccttctattcattgctgaccgccgtgtacttctgcaaccagcttgatgctgttcggcgagagatcggtccaattcgagctgatatagtcgatacaggcgctgcggctcgcttccccgcagacgacctcccaccctgccggaatatgaatgaaggccggccagagtgaatactggccatcctgattcattaaaacgacatatgtgccgtgttcattttcaaaaggatttgtcatcgctatctctccctacttatccgtatcttttttcaagtcgtccagcttttccgaaacccgacgtccgatttcggccagcggctccggctggcacaaatctttatgccggcaatccatatcatgaatatcaatgtttccgttcaaataaggtagccatgactccggatcgatcggatcaaaccattccggtatcacggttgatttgaaaaacagaatatcgccatgaaagacgcggggcttatattcgcttaaaatccggacggaattcacatacgtctcctttaagttcaagatcgcagcctcgtccaggctggcaagcgcactgccgtcgcggcgcagaatatcgatcgcactggaaaggttcagcggtgccccgtcaaggctgtccgggtcgtatcctcccaatgccaagagggcaatcaatgcttcctgctcatcaggcgcatctttaattggaaggaagtgattcgggtaagcatcaagcatgacaagaagcgatatgtcttccccttgttcctgcagctgagttgcgatcgcatgaacaacattgcctccgagggaccagccgagcagacgataagggcctgttggctgaatcgtacgaatgtgccgaatataatcagcagccatgtcgtcgagcgtatcaggtagctcttcctgccttgcgatcccgcgggcttgaaggccgtatatcgggtattccttgccgagtgccgtcattaaaccggcataacaccagctgaggcctccggccgggtgcacacagaacaggggatcttgactgcctccggttctcagcggaagcattacatccagcgcactttgcctgccgccggattcaagccgttcagcaagtccgctgactgtaggcgcttcaagcaggtcgccgatgccgagttcgactccgagcgcttcacgaatgcggctcatcagctgtacggcgagaagagaatgcccgccaagttcgaagaatccgtcatcaataccgactctcggcgcattgaggatttctgaaaaaagatcgcacaggatttcttcctgcggtgttcttgggccccgccctttaacagccgcggcaaagtcaggctcaggcagcgcttttcggtcaagtttgccatttggagtcaatggcagctctgaaatttttacaaatgcggaaggcaccatgtactccggcagagtgcctgcggcaaaccgtcgcagctcagccggatcggtttcttcttcagacgccgggacaacgtaggcgatcagacgcttgtccccgggctggccttcccttacgaccacagcggcttgattcactctatgatggcggacaagcaccgcttctatctcgccgagttcgattctgaagccgcggatcttgatctgctggtcggcccgccccatataatccagagagccgtcctggcgcctgcgggcaagatcgccggtgcggtacatccgggttcccggcggaccaaacggatcagcgacaaagcggtctgctgtcaaatcgggtctgcccaagtaaccccgtgcgagaccgcccccggacacatacatctctccggtgacgcccgggggcaccggttcaagatactcatcaagcacatatacacctaaatcgggaatcccctggccgatcaggctgttcgcttgaagtgccgcagtctgctgatcgagagaaatatagctgacatgcaccgtcgtttctgtaattccatacatattaatcagccgcgggaaatgatccggatggcgttcataccaatcttcaagcctcttcagctcgagcgcttcccctccaaaaatgataaagcgcaaggaaaggagctttcctgtctcagcattgtcccggtcagcctgcatcaattgataaaatgctgaaggagtctgattgagcacagtcactccctcgcgaacgagaagattgagaaattcggccggcgagcggctgattgtatgaggcaccacgataagccggcccccattgagaagtgctccccaaatttcccataccgaaaagtcaaatgcgtaagaatgaaacatcgtccaaacatcgtcagcgccgaaatggaaccattggtcagtcgctccgaacagccgcacgacattttgatgcggaacaacgactcctttcggcttgccggtcgaaccggatgtgtaaatgacatacgccgggtgaagaggcagcaaaggcgcggtgcggtcggcatcacacggattcgcagcagcgcatcctttcagttcctcttgtatacaaggatcatcgagtacaatcctttcaacagatccgggaacagaaagatttgattctaccgctgaactcgttacgatgcagacaggatgggcatcattcaacataaacgctatcctttccgccgggtagtccggatctaggggcacatatgccgcgccagccttcagcactgcaagcaatccgacaaccatatccaaagatcttggcagcgccagggcagcaaattgttcggggccgacccctttggcgatcaggagatgagcaagccggttagcgcgtttattaagctcgccgtatgtgagcgcattattttcacatataaccgcaacagcttccggatcctttgccgcctgcttttcaaacaaaacgggcaaagatgaacaaggtatgctgttggacgatttgctccaatcagccagcatgttttcccgttcggccggaaggagaatatcgagtttttcgatcggctgatcagggtcgtctgctgctgaatccagcagcctgacaagccgttctgccaatgtttgaaccgtatttcgctcaaataaatctgtgctgtattcaagaaatccgccgatacctgcgggtgttccgtccgcttttcgatgttcgcgaagctcaatcgtcaaatcaaacttggctgctccgacgctgcgaatttcaatgtctgacttgaggccggaaaggtcaagctcaggttcaggcgtattttgaaaggcaagcataatttggaacagcggatgtctcgctcttgacctgcgcggattaagcacttcaacaagacgctcgaacggaaggtcctgatgctcatacgctgcaaggtttacttttctgactctgttcagaagctcccgaaaactcggattacccgatgtatctgttcgaagcacaagcgtattaacaaacaatccgacaatttcgcctaaagcatcatcgtttcttcccgctatcgggctgccgagcggaatatcatggcctgctccgagccgtgtcagtagtgcggcaagagccgactgcaaaatcataaacatgctgactccggtgctgcgggacaaatcgaacaggcggccgtgcagctgttcgtcaatgctgagatcaatcgtaccgcctctgtagctagattccgacggacgcgggtgatcagtcggaagctccagctgatcaggcagatgttccaatgccttcgaccaatattcgagctgtttggcaatcagactgtccggattgttctcactgccaagcagatattcctgccatacggcatagtcggcatattgtatagaaagcggctcccaaacaggtgcctcaccttgcagacgcgcattataggcggtttccaaatcacgggtcagcggcattaaagaccagccgtcgccgatcatatggtgcaaaagcagaagaagcacaaatttgtccggtccgagtacgaatagctgggcgcgaaacggaggctccttttctaaatggtaacggtgccggacggcctcagccaggactttttccaactcatgttcgctgacatgggatacagtgagttcgggacgcgattgatcctcttccaatatcagctggtgtgttgtcccttgctgatccgggaaaattgttcgaagcggctcatgtcttgttgccacatcacccagagcagctgccagcgccttttggtccaaatctccagttaaatgaacgacaaccggaatattataggtcgggctcggtccttccaaacagtgcaaaaaccataggcgccgctgtgcgaaggacagcggaatctccttgcggcgctctcttttgcgcaatgccggacgggcgctctgcgcctgatcaagctgtttggcaagtccggcggctgtgggctcatcgaataaacggccgattccgagttcgacgccgagcatttcccgaatgcggccgacgagcctgcctgccagaagggaatgtccgccgaggtcaaaaaagctgtcatcaatactgactcgcggcacccccagcacctcagcaaataaatcacacaaaatttcctcttgcggagtcctcggctcgcgtccgcctgtatgcatactcaccgccggagccggcagggatttgcggtcaagctttccgttcggcgtaagcggcagttcatcaagtatgacaaatgcagacggaatcatatagtcgggcagtgtctcaccaacgaagcggcgaagctcggcaggatcaaggctttctcccgaagcgggaacggcatacgcgaataaacgcgggtcaccgggctggtcttcacgaacgatagcagcagcttgtttaacaaccggatgatttgcaagcaccgcttctatttctcccatttcaattcggaacccccgaattttgacttgatggtctgcacggccgatataatcaagcgacccgtcttcgcgccagcgcacgatgtcgcctgtccggtacatccgcgatccaggcggcccgtatggattcgcaataaagcgctcagccgtgagagcatgtcggttcaagtagccgcgcgctacccctgttcctgccacataaagttctccagccgttcccggaggcactggctgtaatccggcgtccaggacataaagctgcgtattccaaatcgcacagccgattcccggaggttccgtacagttgccttccagcgcagcggctgtagaccaaattgttgtttccgtcggtccataaaggttcgttaaagaacacgcgagctgctgcaattgccgggccaggctggattgcaaagcttcgccgccgacaagcgcacgaagacctttgagcttttccggggcgctcgaggccaatgcatgccagagggtcggtgtagcctgcattattgtaatttcgtatgtttcaatcattttggccaattcggacggatcttgtaccgtttccttctcggcaagaacgactgctgatccgctgatcagcggcaaataaatttcgagtgctgagatgtcgaatgcaattgtagtgacggccagcagccggtcatcttgattaagcgcgaacatgtcctgcattgacagcaaaaaattgaataagctttcagcttgtacgaccacgcctttaggtctgccggttgatcccgacgtataaatcatatatgccggctggttgccggaatgctgttcgccgggattttcttcagaacagccggacattttctccataacagtttgttcatcgaggattaacttcggcatttgcgaaccgatcgtgtcttgcgcttccttgctggtcataacaagcagcggctgtgcatcgttgagcatatactcgatcctgtcagccggataatcgggatctataggtaaataagccgctccagctttgagaacggcgagcatgctgacaaccatttccgctgaccgcggcaacgccaaggcaataaatgtctcgggtttcgccccctgatcgatcagcaagtgagccagttgattagccttttgatttaattcggaataagtgagaaccttatcattgcaaacgactgccggagattcaggacactcctttgccatcctttcaaatcgctgcggaagactctctttgggaagcccgtgttctgtttgattccattcaatcaatatttgagcgcgttcttcagggagaagaatgtccaacgtccccaccggctgagtttgttcgcaaacggcaatcgttttcagaagagtaagaaaacgattgccgtgatcttcaagttcatccgcatgataaacagcagggtttgcatccatgtttacttttagcccgccaccgtccggacggccgtaaatgttgattgacaaatcgtccacaggtcccgtggcaagattatgcacgatgccttgacagccggcaaaattcaagcggttctcaaaaggcatcaaattaagctgcggaccgaacagccgctggttttcgccaagcagcttgagatcccggcgcaattcttcgtggcggtaatgctgatggcgccgcagcttcatcatctcacccgagatttgcttgactagctctcctatgctcatttgcggctgcatgccaattcgaagcgggaggagattcatgaccattcccggaatatgaagagcggctgacccgaggcggcacatcatcggcatcccgagaacgacgtcatttgcccctgtcagacggtgaacatatattgctgctgctgccatcacggtttcgtgccaagttgcccccattctgctcgcggcagacagaagacgatcagcatcctcacttggcaggtgttcagacctgcgaagaaaacttgaagaggtacgcggcgccctttcggcaaggctgaccacctccggttcatcgctgaaacgcccaagccaaaatcgccgatcttcctgatactgttctgatgcacggtaagccgtttcctccgcgataatcaaatcgagggagccaaaggctccgctctggtcgatcgatttgttctgcatcaatgcggtatatatttttgacagccgctcggcgatcaatgtaaagctgaacccgtctgttgcgatatggtgagttcgctgataccagaagtaatgatcttgcgccgctttaaaaagcgcttctgtaaaaagcgggccgcgagtcagatcaaccggacgggcaaggtcatccatcatccagcttttagccgcctgttccggatcggtttctgatctgacatcaatgtaatgtagcggaaaatctgttgacggaacgatctcttgccatggtccgtcttgatcttctccaaatctggcatgaaatgattcagcttctttaatgacatggcgcagcgctttttcgaaaagctcctgatcaagcgggcctttaatttcaacgtattcagctgtattgtagatcggattttccggatcaagctgctgagcaaaccaaatgccggcttgcgctcctgataatggctttcggttatgttgacattcaggcatttaggtgacctccttcattgatagtctgcatttggcaaaggtgcttctttagaggaggacaacagtctccaccagttttcaatcgaagggtcctccgcaagctctacaaacgacacctcccgccccgctcggcgccagcgctctgcgagactcatgattctcacggaatcaattccccggtagatcaaattttcgctgtcgcttatcttttccggcgattcaagaagaagcgatgccacctgttcgcgaatagtctgttttgtcagtgcatgagagctttcttttgcgtgttcatggctttcgccatctttcagtcggctcagaagctgttccgcagtaattgtgacactgcaacggtcagctgcgtatgtgatggccatttcatgatgctttaatgagaaatccgccaccgcatctccgacaaaaaatgtttcaatatcttgcataaaagcatcacatgccgtcatcaggcagccgatatgggcatagattccggtgattatgagctgatcccgcccctgctcctccagcacgcctaaaaggttggtttttctgaaggcattgtacctccacttggtcaaaacaatgtcgccttcattcggtttcagctcatccacgatcttctgctcatcgggatcaggaccgattccgggtccccaaaagtcttggagaagcccccgttcttccggtgtctgggcgccgggttgagccgtgaaaataaccggcatgccgagctcggcacatcgcttccgaagcttcttgatattagccagcagatctgtgaccggagactcgccgtaacggtaagcgttgagaaaatattgctgcatatcgtggatcagaagcgccgcacgcttcggatgaggagtccatgacaccttgtttttcggcatatttgatgcttctggcatttggtacggtaagatggcaggaatggccatcaaatcacatcctctcattttttatcatctgacattctcagctgcagacattttttcagcaatcgccgcacgcagctcttttttgctgacttttcctacgcctgtctgcgggaaatcttcaaccatttctacccggtcgggtattttgtaggctgcaaggcccctttctctcaaaaacgattgcaactcagcctgagccggtgcagcgccgcgagggataatatatgcacacgccctttcgccgagaaattgatccggcatcgagacaaccgccgcatcgagtacccccggatgtgcgagcagatggttttccacttcttccgcggcaaccttctcaccgcctctgttgatctggtctttagctcgtccttcaacaatcaaatagcctgatgaattgactttaaccaagtctcccgtacggtaaaacccgtcttcagtgaacgctttggcattgtgctcctcagctttgtaatagccgcgaatcgtatatggacctcttgtcagcagctctcctgtctgtccgggtccaagttcgcgtcctttttcgtccacaattttaatctcgtcaaacggagacattggcctgccttgtgtgtgaacgatcgtgtcttcaggatcatcaagtctggtatagttgaccagaccttctgccatgccataaacctgctgcagtttgcagccaaacaccgatgaaacgcgtctggcagcttcggcgctgaatttcgctccgccgacttgaaggacctggaggcttgacaagtcgtcccggcgcgccgaagcagcatcaagccagattaacgcaagcggcggtacgagtcccgtgatcgttaccctctccttatcgatcagagggaaggtttcatccgggctgcctcctgatgcaaggacgactcggcctcccgcgtacagcgtaccgagcactcccggcgagctgagcggataattgtgagcgatcggaagagccgcaagatatacgctgttgtgatcgagcctgcaaatctctgcgctgaccctcaagctgtatatataatcatcatgcgtcctcgggatcagcttggacagacctgtgcttccccccgacaactgaagaaaggcgacatcttctggatagacgttttgcggaggtgccggctgatcataaaggcttgccagcgcttcaaactcctccggttccccggcgacaatgacatgacggagcccttgcagcttctcctttacctgtctcgccagcttgcggtagtcaaactttgcgtgacgatcgggaataatgtaggcagcagcttcagaaaactcgcaaaaatacgtgatctcgctatgccgatgcgatggaagcgcaaaaacaggcagagctccgatccggaagagcgcaaagcaaacttcaaaaaactcgatgatattcggcagctggacaacgacgcgatcattttttttgatccccagctttaaaagaccgccagccaaagaatcggctctcctgtctaactcacgatagcttaaatggatatctccgtatgtaagggcaatgcggcttccgtatttttcggcccgctccctcagcatttttccaaaagtttcgcctcgccagcatccctccttccgatatttatccgcaaactccttcggccatgtcgtgcatcctttcagcatctctatccctccgttactcactgttcattcccatcgcaagaagcattgtccgaaactttgcagacgtttcggcaagttcgtcttcaggcttcgacccggcgacaattccggcacctgcgtacagtcgaagcgcgtgttcctccgcctcggcacagcgaatcgttacaacccattctccgtcaccgtccgcgtcgcaccagccgaccatacctgtgaaaaacccgcggtcaaacggctcaatctgtttaatcgcttctttcgccgcattcgtcggcgtgccgcagacagcgggcgtcggatgaagggcggcggcaagctccaatgatgatacagagaggtctgtaagctctcccttcaattccgttgaaagatgccacatcgtcggcgtgctgatgagcgacggttccggcacctccagcttccggcaaaacggcctgagcgcggaagcaaccgcttcgacaacgaccgcatgttcgtgacggtctttaggcgaagcaagcagttcagccgcccgtcttcgatcttcttcgggatcatcgctccgaggtcttgaacctgctaaaggatttgccgtaacgcagaacccggaccgtgatacaagcagttcgggactcgcgcctatcaaagtggtgcgaggcgcttcagatgactgcccggttaaatcaacggcaaagttgtacccgcttgtattgcggcgggcaagatttcgcagcaattgaccgatatcgactttgatcggcgaggtcagctgcaatgaccgggaaaggacgatcttgctgtattctcctgctgctatacctgccaatccttgtctgactccggccatatacgcttccgggcttggaatctgctggacatcataggggtgcagggcaggttcaggcacctctttatcgtcttcttcacatgtcagcggccccgcatgccacgcttcgaccggcacggttaactgcgccggctttgcatcgtcaaatggcacagctccaactacaatcggattttcctgcccgttctccctggcttttttcagaacttccgcagtccgctgagcaaggctttgctcttcggtttgagaaacagaagcaaaaacaccttccgccagaatggtccgctcaggggaagagaaaaagaatgaagcaccggcctgatattcctttaacagatgatctgcaagcgcttctgacacgacatgacgttctatcatcatcaaaacctcctttagattgaatcaggctccaagcgttgctccgccatcgacgcgcaaatcgtgcatcgtaatatgacgagccccgtcagacagcaaaaatactacagcatctgcaatgtcagccggcgaagccaattttccgagcgggattcccgttttgaatgtttcaagtgatccttcaatgacgccttgcgcagcttcctcacactgccatagcgaccgctgcatcggggtatccgttgatccgggcgatatgatattgcagcggatattgtactcggcaagttcaaggccgaggcatttcgtaaacattaaagcggccgccttggaggccgcgtaggcggccatgtgcatccgcggcacagctgccgcatttgatccgacagtcacgatcgctccagtcctgcgcggtaccatccggcgggcgacggcacgcgatacgttaaaaaccccggtggagttgacattgaacgtcttctcccaatcttcatcactcaacgaatggatcagacccgttctgagcacgccggctacattgacaagcatgtctatcggaccgatctcgcgttcaatatcggcgataagctggtcaactgcggcactgtcgcccacatccgcggcaaaacctgaaccctgcagtcctttttgttcaagttcgtcttcaagttcaagcagcccttttcgattttgatcagccgctgcaacaaacaccccgcgtccagcaagcgccagggccacttctttgccgattccttgcgaagccccagtcaccaaagcaaccttgcctttcacttttatcatttcctttcttaaagccggcagcgcccgagtctcaaaaagtcactgccggctaaaattccaattgataatgataatcattatcgtttaaaaatataatataccaataactgctaacggtcaaatcgttttcgaatgtttatccgtatcaatgcgcttggtatattatcagttatctattctcatgctttttcaaagctcggggcgccggaagcgccccgctatcaatcaggcttgaaggcaaaccgcagcgctctgctgattaacacaggcagaaccgatatatgaccttcccctttaaattcatggtactccgcgcgaaccccctgactttccaaagcggccaagcggtcggccagcctttttgcattgtcgttcatcccgcttttatgcgtcttttcgagttctccggccccaagcaatacctttacatcgccatcagcttcctgcaacttcgaaacaaagtcatgctctttatcaaaaaatgacggatgccaatggatggacggactgccggcgatatatgtctgaaatagatccggttttgtaaacagggtctgcaggacaaaaagtccgcctagggaatgaccgaaaatcgcctgccttttcacatcaatcgtgaattcctgttcgatctccggctttaactgctgttcgatgaaggacagaaaagctttcgccccgcctggttccggccagtctgctccatcgggcctcatgggcagctcagcgcccgattccggcagagtaaaatcataataccgcccccggtcaaagggagcgtcggtctcgtaaccgatgccgacaataacagccgtccctacaccggttttatcgggacggcgcgactgcatccgcaacgcctccaccatcgttccaaacacggaattggcatcaagcagataaatcacgggatatcctgcgggcggctgttccccaaatggtttcgcaataaaaatccgatatgtgcggctcccatccagtgaacgcatgcaccgctgttctgtccccggtatcgcaaccgggatgcattcagcagcattgacagactgctgaagtttttcttgagccatatcattctcccttcccctctttgatgagctaaaaaacagtctaatgaacagtctttttttgtttgaaaagtaaaaataagaagtacggcacaccgaaaatggcgataatgatacccgcaggcacctcggacggctggaacagcagctttccggcaaaatcggcgcacaatacgagaaacatcccgatcaatccgcttaacagcaatgagtggcggtgcaggacgccggcgagcctccgcgagatgtgcggagcaatcaggccgacaaatgccaagctccccgaaatagccacacaggcgctgataatgccgacacaagccgtgagcagcaccaccttttcaatattcgcggatacgccgagactcttcaccgtatcttcatgaaagcgaatggtatcgagcaggccggacttcatcagcagaaatggaataagaacaagcagccacggcagtgccgcttgaatatacgtccaattcgccgaccagatgcttccgtttttccaaaccatggccatttcgtggtcattcggattcatcttcaatgacaggtaaagcgaaacagcgctgaaccctgaattaatcgcgattccaacgagaataatcctgcccgaatccaagttgccggcgtgccaggcaaagataaaaatgaatattgcagccaaaatgcccccgatcaagccgaagaatggcatccccattgcagcgagcaggcttgtcgtttcggtctggccttgaaagatcagcatgtagccgacgatcgccgcccccgcacctgcattaatccccaggattcccgggtcggccagtccgttccttgtcatcgcctggatgacggaaccggcaatgccgagcccaagacccacgagtgccgccgtcacaatccttggaagacgcagctcaaacaggagaatggcgtattgctcattcgggttgatgtgaagcaatgttgataacagctcagccggatgtacggcaaacgatcctactgttatgctgagataacagattgtgagaatcagcacaataaaaacagcatagatgactgcaacctttttaggcacgctgctcccctccttttctcttgatcaaataaaggaagaaaggaacgccgatcaccgaagtaacgacttcaatcggtgtctcaaacggatagttgatcagccggctgagaagatcggccagcgtcaaaaaaacgccgccgagaacgcaggagcacgggatcagccggctgtaatccgatccgacgagaaaacgcgtaatgtgcggcacgaccagtccgacaaaagcaatttttcccgccatggcgacagagcagcctgtcagaacgacgaccgctgccatcgctgtccatttgacggcctgctttttctggccgaggctttcggaaatgtcatcgcccaatgataaagctgtcacttttttgctgagagagagcgccagaatgatgccgatcacaaaaaacggcacggcatacttcagcagctcgggattcaattgatgcagcctcgcgctgtaccagaagctgacgtcctgggaaatttgaaagtaaatcgatatcgccgcagacagactgctgagcagcatgcttgttaccgtcccgattatggcaagttgaaccggcataaaaccgtttggaatcaccgaggcgaggccgaagacaaggccggcgccgacggctgatccgataaacgaatagcccatcatctccagagaggatgaacccggaatcaccaccatcaacagcgtgatcacaaacgctgacccgtcggaaacgcccataatcgacggggaagccaagtaatttcgggtgacaccctgcataagcgcaccggacaccgccagcgccgctccgattaaaagagcgccgacagcgcgcggaagacgggaatgccaaatgatttgatgatctgtgttgcctgtatcaaaatgcagcagcgccgaaaaaatcacctcgggctcaagctgttttgcaccgtaacataccgacagaaaaacagacagcagtatggcaaacggagcggcgatcataatgatgcgggtcatttgctttgaatgcatagctcaatgaaccttttctatttgttctgcgccaatttctcagctgcagcctttaaaaattcaaccttgctccatgccgttccgccctgcgcaagcgggtctacagcattgacaaatacacggtcatttttcactgcagaaatgcttttccaaattggatttttctctagatctttcagcgcattcggattgtcggcattctcatcgtctgagaattggacaaacatatagtccggattcatttcactcagtttttctaaagaaaccaactcctgggcttttgccgccttgacttcttttggagctgtgaagccgagctcaccgtataatgtggaattgaagaatacgtcttccggatagataaagatattgccttttctgattctgacaacgagcgcttttgtatcttttgccgttttctcaagctttgttttagcttccttgaggtcggcttcataatccgaaataatctgcttcgctttatcttctttgcctgtcagttcagccagcagctttaaattgtctttccagtttgaagaaacatgggaaacaggaatcgtcgtcgcgatgttatccagttttttcaccactttatcaggaaatttcgttgaagccaggatgacatccggtttcagctcaaggattttctccaggttcggctccattttttcgccgacagcggttgctttgtcagtaatgctcttaaacagatccgggaactttccggagaaggaaatggcaccggctgggtgaacatccagaagcttggcatcttccatcgattccacgcttcccgtaatgacgatttgttcggccgggatcttcaccttgtatgtatgatcgaggtactcgatgctcttctcagctgacgctgtgctcttgccatcgccgccagccttttctttgctgttcccgcatcccgctgcgccaagcgcgagaaggagaataaatagaaatattgatatttttctcatctgactgagaccccctgatttaattgataactattatcaattaaaattataggtaagcctcttcgataacaccatggataatatccggcaattaaaatggattttttccggacagcagccgaaccgcctggcggatgattcgttcatggctgcatgcggaatattcccgccaaggatcagaattcacctgatacacccggtgatgccgcaccgctttcaaatcctgccaagcagccgactgctgaagctccctgtagaatgccagcgtctccggctctttaaaaatgaaaatcataatgatatccggctgataggctgcgattgtttcgatcgacacggcccggtcagtcggttcttccagcgacacagccgattcaaagccaaggtcgccgaaaaatacatcttgaacagaacggttatgcgccagataaatctcgtgtttatgcaagcgcaaaaacaaaaagcttcggcgtccgcagatcggataaagcgcctctttcgcggtctcggtgagacgctggtaagacagcagccatttgtgagcctccgcttcttcgtccaaatgggatgcggtcagcataaaatgcctcctccattgttcctgtgaaggcaaaaagaagacatccgcgatcgactggagctgttcccgctcctcgtgagacacgctgtccatgctgataatgagctccgggtcagccgatgacaatgtccacaggttttcttcccacggctcgtgaaagcggtatgcgctcagatggaccggaatatctgccgcgtaatgcttatagtaatatgatgtccacttcggatgcagggaagcggcgtaaggaatgaggtgaagcggtatcagctgtccgatcgtgttctggccgtaggcagccagctttctgcgcctttttttcatataaacggtcggggataagcctgtatgcttcttaaacgtcctgctgaaataaaattcatcctgatatccgatttggcttgaaatttccctcagcttgtagctcgcttttgccatcagctgcttcgctttcgtcatccgcgtctcagtgataaactctgtcacgctttgaccgtacagctttttgaacgtttcgctgtagtgcttcgcgctgattccggccatttgcgcgagttgatcaagcgtcaggtgtgcatctgaatgctcctcaatatactcctttgtttttcctatggctgatgcggtgttttcgggatgagtcagtttggccgaatagatatcgtacagaagctgctgcagatctgcttggcatttcagctcctggagcgctgaagatgccggccataaggcggaaagttcctgaagacgggaggccagatttccgacaggatggacattcatcatctgaaggtcggaaaaagcgtcagggtcggtgtctgcttgaagcgtcaggcggcggtcttcatagcagtagggctgcagcctgatgagataaacgctgatttcctctgacgaagctgtgattccgaatgtttcataaggcggaacgatatacagcgtttctttttggaggggtctgcctgatgcttgtatatcgattctgccttcacccttcaaatgaaagatcaaaacgaaagagtctgcgagctgctgttcatccggaagatcgccgggctttcttatatgatcaatttgcaagagacgatagaaataagaagatttcatagaaaaaccgcctttcttaacccagtgatattacaaaaaataaaaatgcccctaaaacaatatggtaaattggttgcggggtgcttgtccggcacaaaataccagtttgcaaggtgcatttcacatcacttatagctgatatgcttcttacgatttactataacacagtcacttttattgtggaataatgtatccaaagagaccatctgcccaatcctgactttaaaatataataaaaaatcaatacttatcatttcaatatccttttacctagtgtataactatagagaaattactatatttacagggaaggcgtgacttcttattttggaaatgacagacagcatgaaaaaatcgcttgatgcgattgcaaaatggggaaaaataaccggagtttttatgattatcgccggaggcatctatgcctttttcggaatttctttgcttatcatcggagccgctccaggtgtgctgatgattttttcaggaatctatcttcttaaatcggcaaacgccgctcagaaaatgagtcatgacatgccgcaagaaccgcatgaagccttgcttgataactatgtgaagtttatgaaatggcaatttttctacttactatcgaatattgtgatcttcattttatgcataatcgtttttttcttcctgatctttttaggtgttctagccgattcttacagcgggtatgatccttattattacgaatgatgatcaaaagcctgtctcggatcaatttccgagacaggcttttattattgagcttctccgacaacagtgaaacgctcattgacatgctcgcctttttcagcctcgtccaccactgcaatggcgtagtctgcatagctgatgtagctttctccggcggtgtttacgattaagttttcctgacctttttgataagaacctgttcgctttccttccggattaaaaaatgccgccgggctgatgaacgtccatttcagtccatctgcttctttcaaatcctgaaggttctgcccctgatttttagccgtcggcaagtattctttaggaaactcaggcgtatcgtacagctgggttgttttttcctcatcgacataaaggctgcctgcaccgcctacgacgattaatcttgtttcaggaacctgcttaaacagttcaatcagctttcttccagcttcaacatggagatgctcctgccctggggccgcgccgaatgcattgacgacaacatccagtcctttgatgtctgccgctgtcaggttgaaaatgtctttttcaatgacagctgcatcgctgttcgccatttttgacgcacttctgacaattgccgtcacttcgtgtcctctttctgatgcttcttttaaaatcatgctgcccgctttaccgcttgcaccgataataccgattttcataatcgcttcctccaataatttgattatttgtaacaagatttgttacatgttgatgatgaaacatcatctcttgtttaaaagagatgagttaagacgtctttaagagacttgctggccaattcgttctccatcgcctgctgaacgctgtgaaacgtttgatcaagcgttgtttgaatttgtcttccaaccggacagtttggattcggcttgtcatgaatcgcaaataattcctcatgcggctgaaccgcgcggtaaatatcaagcagagatatatcttcgggatctcttttcaggcttgccccggccactcccggccgcgacgtcagaataccggcttttttgagctggctgatcatgcgcctgattacaaccgggttcgtattaacgctcccggcgatcatttccgaagattcccgcgggtttgcggcgattaaagacaatatatgaatggccactgaaagacgggtgttcaccatatgttttcaccaccgatgtaattattatagttacaggtcacgtttttgtcaactcttatcatatccttaatgatcgcaagaataaataaaaattttttcaaaccctcacgtctcacttcggaactttttcacagtctctttcgtatctactgatgaaaggagtgtttttcaatgaaggagataacagaaggaaaagcagctttggatagccggcttgagccgaatgaagagatcagatctattattctttgcgcttataacgcgagactgtctgcacgttacactccgtacagaggcgtgcttgccgccactgacaggcggttcatgttttattcctccctgtttggctccccttttcatcttgacatccgctatgatgccgtcacctcgtttcgccgcgaaaaagggctggtaacaagaggcgatcatctcgtcgtgatgaacaacggggatcgggaagcatttcaatattttagcggctgtgatcctttagagacattcgtcgaagccgttcgaaagctaaagaaactgcctgaagacatcattcattctgaaaaacgccggctccgggatgtgcccgcagccggctgctcagttattaatatcgtacttctctccatacctcagcactttataaattgccattccatcagaaagatgattttcggaatacctcacgggaatcaaagcaaaaaatacataataggttgaaaaataaacaaattggtagaaaaaaatattttcgggtatgatgtctttgataatcagcagattgataataaatatagacattaagttaaacagcgatccgccagcataaatcatcgcattcgtgaaacggttatcgtattttaaatccccgtatttgcagaaggaatccatgaagtagacacttctgatttgaacagggccgattttcagcaactttttgcccatcccgatttcaagcgaagatttcccgccgaacaacaccgccatggcgctgtggcccaagacatgaagcaccgacacggcaggaaaaacgatcaagaacgaccagaggaatttgacaatatcctgcagtccgaacattcaatcatcctttctgtttcaggcaatgttttttaagaaaatttccgcttttcccccgtatcaaacctgtcaatatgcaaaacaagcagacctcagcatgaaaaaaaccgcccatctactctatggacggccttctcaggagcagtcaattatcctccaatataggacatttcaacctttttccgcggaaccgcttttgcaagagcgcggtcgagagaatattggtcatcgcgattccgccagacggtgccgatcgcctccgccagctcctgatcggtctgcccgcttctgatcaaggttcttaaatcaaacccgcttgatgcgaaaagacatgtgaaaagctcgcctttcgccgatagtcttgctctgttgcatgtggtgcaaaaagcatcggatacagaagagataaaaccgatttctcctgagccgtccaggtatcggtatcgttttgcgacttctccttcgtagttcgggtcgatcggttcaatcggcatatcttcattgatgatccggatgatatccgctttggccaccactgactgacggttccattcatttgtgttcccgacatccataaactcaataaaccgcaaaatatggcctttttctttgaaatagcgggccatcggcaaaatatccttctcattgacccctttctggacgaccatgttgatcttgacgccgagtccggcctttttcgccgcttcaattccggccagcaccttgctgacggaaacgcctcttccgttgatcgatttgaaacgctcatcatccagggaatccaggctgaccgttacacgtttcagccccgcttttttcagcttgtcagcgtaaaccggcagcaaaacgccgttcgttgtcatcgcaatatcgcgaatccctttgatccctgcaagcttcccgactaattccggcatatcttttctcatcagcggctctccgccggtgagacggattttttctaccccgaactgatgaacaaacagcttggccaatcgttcaagctcttcaaaggacaacagttcgccttttggcaaaaacggataatcctgcccaaagatttctgcaggcatgcaatacgtacatcttaagttgcagcggtcggtgacagaaattcttaaatcccgaagcggccggcttttctgatccaaaacttgttcactgttggtgttcacgcctgttgcctccttttatgaaaactgaattcgctcgtgatgcgtgtatacattgaatgaccggtttctcgcaaaaccaatcgtcatgatattcagctcctctgccatctgaatggccagctcggtcggcgccgacttggaaatgaccgcggaaaccccgattttcgcggctttaagcagcacttccgaagaaattctgccgctgaatacgatcagcttatcgcgcacaggaacctgatgaagcaaacaatatccgtacaatttatcaagcgcattatgccttccgatatcagatctgactgcaatcagcttgtctgtgctgcacaaagcggcattatgaacgccccccgtatggtgaaaaagcttgctgcttttctgcatgtcgcgcatcagcttcaaacagttctctggcgtaatggtcacgccgtcaatcgctgtttttgcggttttgacgtcctgctggaaataaaaatgcctcccttttccgcagcaggagccgatcacccgctttgtgtaatccttcagctgcagcttttttgtgctgacaaggtcgacatatgcgaacccgaggctttcatctattgtaaaccttttaatctcatttttaaatcggatcaccccttcagatgcgagaaatccgatcaccagttcttccaggctgtccggcgagcaaacaagcgtgacaaattcctcgccgttcaccatgacagtcagggggaattccgtcgccatctgatcttcttgctgcaccagctctccattatcataacggaaaatttttcggcttgttgtgatgtttttccccatgaataactccgcccctttgtttcttactatatctattactatactcgtctatcatgccgtttcacaaccgtcaggtcaaatttggaagcttcatcttgttgatagcttgaaaacatgatattattttttaaaagttcaaaaaatattcacttttcaaacagactgcccttcttcgcagcaacttcggaaaccgctttcaaacaatcgctccccggcagccttctgtctttattacagcctttttccacagggggttctcacatgaaaaaagcgaaaaacaggtggctcattgctttatgtgctgtaggcattcatttgtcaatcgggtcggtatacgcatggagcgtctttacaaacccgctcgctgaaaccttcggctggagcctcagccagatcagtctgacgttcagcatcgctattttatttctcgggctttcagccgcatttttgggacacttcgtcgaaaaacacggccccaaaaaagcaggcatgctcgccgcacttttcttcggagctggcgtgacgttttccggcttcgccgttcagatcggctcccttcccctgctttatttgttttatggagtcttcggagggatcggactcggcgtcggctatattacacccgtatcttcgcttgttaaatggtttcctgaccgccgcggcttggccacagggcttgccattatgggcttcggatttgcggctttgatcagcagcccgatcatgcaaaagctgatctcagcggtcggtatagccaacaccttttttattctcggcatctgctactttcttgtgatgatgctctcttcgctttacctcgccccgcctgaagaaggctggcagcctgaaggattttcaaccggaaaaagcggaagagcacaaagcgctgatatttcccagctgacggcaaatgaagcgattaaaacgaaacgcttttattatttatggctgatgctttttattaatgttacgtgcggaatcgccatcatatcaatcgcttcaccgctggcgcaggaaagtgcgggcatgtccgccgccgcggccgccgcgctcgtcggcgttttgggcgcatttaacggtttagggcgcatcggctgggcctctgtatctgattacatcggacggccgaatacgtataccgtctttttcgccatacagctgatcgccttcccgcttttgccgttcatttccgacaaggccgccttctctgttttgatggcattgatctatacgtgctatggcggagggtttgccgcaattccggcttatatcggggatttgttcggaacaaagcagctcggtgcgatccacggatacattttaacggcttgggcggcggcagggcttgcaggcccgatgttctcttcttgggtacgcgatgcaacagggagctacagccaaagcctgacggtgtttgcggcactgttcgccatcgccctgttcatttcgatattcattagaacggacattaaacagttgcggaaaaaagcggcggttcatgtctcaaactcgctaaaaggatgatctgcagtatccgctggaaaggagagaagggaatgggaaaaacaaagcatcaaggtccgatgaagctgaataaaaagcccgcgccaaaactgtgggcgtcttgggcgccgatgggactcggaaaggtaaagccgaagcatatcagagatacgatgaaaacagcgtgggacaataaagacaaccttccgtacgcctacagaattttgacgcaaggcgtgtgcgacggctgtgcgctcggtgtgtccggactccgcgatcagacgctcacaggccctcatttatgcacgacgcggctgaacgtcctgcgcttaaatacaatgcctgcgatcgaggacaaatggctgtccgccgacatcgaacagctgcgaaagctggacagcaccgagctgagaaagcttggacgcatcccctatccgctgtcgagaaaaaatggtgaacgatcgttctcgagaatttcgtgggatgaagcgctcagccgaatcgcggacaaaatcaaatcgattgataaacggcagctcgccttttatttaacagccagaggcataacgaatgaggtgtactatacggccgcaaaagcggcgcggtttatcggcacaaacaacattgacaacgcctcgcggatctgccactcgccaagcaaaacggctttaaaaaggtcccttggcatcggcgcctcaagctgcagctaccgagactggatcggaacggatgtcctcgtcttctgggggtctgtcgctgccaataatcagccggtgtcaacaaaatacatgtatgccgccaaaaaagcgggaacgaaaatcattatgatcaatccgtaccgggagccatcgatggagaaatactggattccatcgatacctgagagcgcccttttcggcaccaaaatcaccgatgatgtttaccaagtcaatatcggcggcgacattgcctttatgaacggggtgatgaagcactggtttgaaatggagcgggaggcaccaggttcaagcattgaccgcgcctttatcgatgcacacacaaacgggttcactgagcttaaacagcacatcgaaaaacaaaattggaagacgcttgaagagtcatccggcatatcaaaagagagaatgaaagaattcgccgtcttgctggcccgggcgaaaaccggcgttttcatttggagcatggggcttacacagcaccgttttgcgaccgacaacatttcacaggtggcaaatctcgcccttttacaaggattcatcggcagaaagcattgcggcgttatgccgatcagagggcacagcggtgtgcagggctctggagaaatgggtgccgatcctttcgtcctcccaggcggtgattttgacgaggaaaatgccgcacggatcgagaaggtttggggcttccgcttaccgacttggcaaggcgatacgatcggccagacgatcgaaaacatgctgctgccgagcggaagcgaaagaaaagtaaaagtgttttatacaagcggaggaaactttttggagacgatgccgaaccctgattttatcaaaaaagcattgcaggaagttgaagtgagagtccatcaggacatcatcttcaatacctctaccctggtcgatgccaaagaggaagtcatcattctccctgcgatgacaaggtatgaacagcctggcggaggaacctcgaccagtacggaacggatggtatacttcagccccgaaattaaaggaccgcgcatcggagaagctcgttcagaatgggaaatttatgtagatctcgccaaacgggtccggcccgaagacaaagaactgatccattttgacggcgctgcggaaatccgtgaagaaatcgctgctgccaaccggaattatgacgggattcagcatttaaaaaaacgcggagatgtctttcaatggggcggcgcctggctttgtgaaggcggtgtttgtccgacggcagacggcaggggcaacctgatccctgtcgatcttcctgaaaacagacaaacggaaggacgctttctcgttacgacaaggcgcggaaaacagttcaactcgatgatttatagtgaaaaagatcctttcaacgctgcagatcgccgggatgtcatgatcaatccaaaagatgccgaggagctttatattcaagatggagaagcgatcgttctattcaaccgctacggaactttccaagggcgggcaaaatatgccggcgtacaacgcggaaacacggcagtctactggccggaaggaaatgtgctgatccctaaaggcgtatacgaaaaccatgcccgtattccggaatacaacacggcggtcatgattgaaaaggcggagattttccattcgagaaaagatccgcgctatgcagaaaaacgaatcgaagaactcgaaatgtcgaccgattagcttaacagtcgggacggctctgctgccgtcccgttctcgtatggagttactgagacagttttacgccttcttctttccatacctttttaaaatcagaagctgagtcggcttcaatcaattttccgccgccggcgtcagctacttttttaagctttgctttttctttcacggtttttacatccagcccaacaatgttgacgatcgttttaatgttggatttgcgcagatcttttgctgcctgaacaggatcccctccgcatgtttcttcaccgtctgtcacgatgtagacataattcttcccatctttatcggcaagatcatcttttacatcataaagagattttgcaatcggagaccagcctgtaggcttgattccgcttaaagcgttttcgaatgaattgaaagaaaacggctgcagatcatagacggtttcagtcgtaccgcaggatacttcttttcctgagtttttattgttgcctttatgtccgaaaacattcagcatgacattcgcatcgcttgaaagcaggtcggcaaaatcggttacggattctttggcaatatcaaattttctttctccttcaaccttttgtgccatgctgccgcttgcgtcaagcacaactgcaacattgacatcttttttgctgttgtccgcatttccgttttcagccgcaaaagctgctgccggcgccaatgacaaaagcatggtgaacgttgtcaacagagcaaacctctttttcaactttctcactttcctttccgcatttgttttttcggaccgatcttccgcatgagatcaagtccaccaacatcgtaaaagaaggcttgatagaaataaataggccggatctccttttcaaattcacaaattcttcataatccttacaataatcgatcgacgcattcacttaagacctatcaaaaaagtctgctaaaaggccgatttcatcccaataaagctaccgttacgacaaataacccctccaaaggacgcagcagggttcaacgctctgacacaataacttaatatttgtaaagtatttttcttgacttttgacaatcttttcctcacaaaaggaaagctgcggaaacatgtccacagcttttttccagtttatttagaaagctcaattgcttcctgagtaaaaattcttttgatgtcatttttagtttttgcctggaaatattcaccgccgccagctgctgcgatactggtcaattgtccgtggaagtctccttcataatcaaagccgatcacgttgacaactgcattggatttgcgcagttctgttgcgacttttaccggattgcctccgcatgtttcctcaccgtctgtcagcagatagacgacgtttttcccgttgttgtccagctggtcaagcgcgttttttgcatcttgcagcgcgtttgcgattggtgtccatccggtcggtccgatgccgtttaaggaattgcggaagctttgctcgtcatacgtttggaagccgtacacccctctgattgcattgcaggactgcacttttccggaatttttattgtttccctctgaaccgaaaactctcatgagcacgtttgcattttcaagcttggaaccaaagctgaacgcttcatttttggcaagctcgtattttgagaccccgccgatctttttagccatgctgccgcttgcatcaagcataatcgcaacgttgggcgcatcttcggcaactgttacctcctgttttttctcagctgcaaaagcaggcgaaccaagactgagaaccatagcggtcaaaatgcccaatgtcatcttcttcttcatttctccctttcccctttctgaaataaagtcgttaacacattattatcgtagaagaacaccagggagaaataaatagggcatgtctccttttcctcgttattcaattcatcatacaacaagtatataaaatagactttataacctgtgacccctattgttgatacggcgtttgcggccttttgacgctgttcagcaagccctccggcacatgtttttagaaatatttgtataataatttagcgtgcatcaaattcatgggaatgccaaatttcgatgatattcaaaaagacgccgccaagaggcagacgtcttttgttttattttttcgccatgtatttatttaaaaattcatctgcattggatacggctgttcctttgtaataatacttgacgatgtcttctgctttcttgccgtctttcgccatataatgcgcaccgtattggctcattcccactccatgtccaaatccccttgtcgtgactgtaatctgattcccgtcgcgtttccaatcaaagtctgccgatttgaggccgagcttttcgcgaatatctcttccctcaagcttctttccattgatgacggcagtcgctacgcgttttcccggcgttctttcggtgatctctccgatgctgtttgaaccgggcagcttgacaccgagcttttgttcaaattcagcgacagtaaacgttttatggttcaggaatttcggcgattttgtgtcccaggagcttttcacgctttgcaggtacggaatatcacttgtccaataagctccggcattctcggtgtacccgttgctcgtcgagaagaacgaagcatcaataggcttatgctcataggttaaaattttgccttgcgtactggctacagcttcggtcacctttttgattttccaatcgtaatccttcttccacagcctgcggagctcctctttgtttttatacacctggaacatctgcgtatcatcgaccagcgagcctttcggcgactgtacagcttgctctgacaccatttgcctcacaatgtatgtgcgggctgccagcgcttgtgcttttaaagcttcgatatcaaaatctgccggcatttccgaggcaacgacaccgatgacatactcttcaagcggaatgtcttcaactttccggtcagccgttctgtagaccggaattgaaacgggagactcttttaaggtgactttctttttttcctcgtgttgctgagcgtgtttctctgttttaattgcccccggtcccccgtgaaaagggaggacaagcagtgttggtatgagtaaaatcagcgtgcagattcctgctagtacaattatgagctgtttcaaatcagtgcccccatttctgttttgtctctttcattttatgggcggggacaagctaatatgactgtactttttcaactgctgctacgtattttaaaagcaattcttgtgcataatgatagatatgggaggcatactgatatagaatacttgaaacgcaaaaatcagtatgccgtatgacatactgatttcaggttgatttatgcatttaaatcggatacaacttctttattttcaatatgaactgcttcttcatcgttaacgcgctcaatatcagcgccgagaccggcaagtttttggtggaagttgacatatccacggtctaaatgttttaattcggttacgcgtgtatgaccgtcagcaacaaggccagcaaggataagagctgcgccggcgcgaagatccgttgcggcaacttcagcgccttgaagctgcacaggaccattaatgatgacagaacggccttcgattttaatatctccgttcatacggcggaattcttccgcgtgcatgaagcggttctcaaagacggtttctgtgatcatgctggttccatttgcgcgcatcaaaagagccatcatctgtgactgcatatcagtcgggaaacctggatgtggcattgtttttaaatcaataggcttcaattcagaaggaccgatgatccgaagaccgtctccttcttccaagatttgaacgcccatttcttccattttcgcaattaaagatgttaagtgctcaggaaccgctccctttaccagtacgttcccttcggtaatcgccgcggcaaccatgaacgttcccgcctctatccggtcaggaataatcgtatgttttgccccatgaagcgccttaacgccttcaattttaatggtgcctgtaccggcaccccgaattttaccgcccattgcattgatatagttagccagatcaacgatttcaggctctttagcagcattttcgagagttgtcgtgccctcagccaaagctgcagccataatcaggttttcagttgctccgacactagggaaatcaaggtaaattttcgctccttgaaggcggccttctacagtcgcttcaataaagccgtttccgaccttaatttttgcccccattgcttcaaagcctttcagatgctgatcgatcggtcttgaaccgattgcacatcctccaggcaaagccactctcgaatggcctgtgcgagcaagaagcggacccatcaccaatacggatgcgcgcattttacgaacatattcgaacggagcttccgtagacaaagtgcgagatgcatcaaccgttactgtattattttcaaaatgtacacttgcgcctaaatgacgtaacacttcgttaatcgtatatacatcggagagcgtaggcacatcacatattacgcttttttcttcactggctaataaagatgcagcgataactggtaaaacggcattttttgctccttcaactttgactgtgccgtttaactttcgaccgccgcggacgatgattttttccaaggtattcccctccgcgtcccaatttctctatattaatattcagtcgtgacgattggtgtgccaaccgtgacggtaagtttttcgcccattcccgcatttctaagcgagacttgcaaattcatacggtgtttttctgtcttgatggattctttccactcgttagtgtaagcagaaatagaaacgaaatttggttcaattaaatcttcaactgactttgcatcaaattcatgtactagctcatttgcttttttttgcaaaacaacattcatcataccatttaaatggccctttagacaagtaaaaattgcggtcttttctcgcattatgtcgaatgcatcccgttcaaactgcttatatgtagcattccagttttcccgtggtcccgcgcctttttgctcatacaataaatacgaaacaagtctctggtttttgtgggtggataccaaatgtattttggaattgatatgattttttttgtcctgaaaaacacctgtcgctttaactgtatcgtcgtcttcccgcgttaaagtccattcatattgtcgatgctgtttcttgaaatgtttcagttttgcaaaaaaatctttttcacttagggtaagctgtttttttgtatgcatggtccactcttcaagctcgacatcatggcggctcaaaccttccgccagctgttcaagcggcgtattgcccgctgcttcaagcgattgaaagacatgaacaattaaaaataaaaccacactaaaaataagggcattaaccgtttgttttgtcttcattctgcatcatcctctcctactctccattgttgacggatcgcaggaaaagcatacgtggaaaaacaaggtctccggtgattttgcagaacgcggtgttacccatattcgtccattcccataaattctttttcttttactcaatcatgaaaataaattttgaagctgtctggaataataaagatagtccaagaaaaaattgctgacggtggagccgacggcgattgtaatgatgatcattaacaccctcgcctgaatgacttttcctttcctgataagcggatcaatattgaccgccagaagagcccaccaagtcaatgcaataaaaaaaagatgaacgatgatactgacagcagcctgttgtccgatctcttccattattgatgatgcctccttacgttcagccggtttggtgcttccggccagcctcgtctcttctgccgtaggataaaggaatgttgctggtcatttcaagtcattttaacagttttgatgttgcatgttaagtcgttcatgatagaactttttcccatagatggagtgatcctctgttgcctgaggggcttgtgttttaggagcttacttgaatgtcttacgtcctctttttggtggaagagaacatagcttactattttgtattatagatagattcatactaaaaaggcgaacaatttgtgaacatttttcaacattttcaattctgtttgatcttgaatataaaagacccttcccatccttaaatatgggaaggatccttatctctatctcgcaacatccaaccggttaatcgcgcgttttaaagcaagctctgcccgaataatgtcaacatctggagtttgcttttgcaaacgttcctcggcacgccgttttgcggccaaggcgcgttctttgtcaatttgttcagatgtttccgccgtctgggccagaatggtgacatggtcagggcggacttccactatccccccgctgacggcaaccagctcagtttgaccgtcttttttcagacggactgcagcaatttttagcggagcaaccgtcggaatatggccgggtaaaataccaagctcaccgctctctgctctaacgcttaccatttctatatccgcatcgtatactgggccgtcgggagtaacgatattgacttttaaggtcttcatgcttttaccctcctaggaccagattatacttctacacccatttctttcgctttttcgacaacttcttcgattcggccgacaaggcggaaagcgtcctcaggaaggtgatcatacttaccttcaaggatttctttgaagccttttaccgtttctttgacaggtacgtaagaacctttttgtcctgtaaactgttcagctacgtggaagttttgcgacaggaagaattgtacgcggcgcgcacggctgacgacaagcttatcttcgtctgacaactcatccattccgagcatcgcgatgatatcctgaagctctttgtagcgctgcaggatctgctgaacgctgcgcgccacttcatagtgctcttctccgacgatttcaggcgaaagcgcacgggaagtggatgcaagcggatcgaccgcaggataaatccccatttccgacagcttacgctcaaggttcgtcgtcgcatccaagtgagcgaacgtcgtagccggcgccgggtcagtatagtcatcggcaggaacgtagatcgcctgaatcgatgttacagatccgacatttgttgatgtgatccgttcctgaagctgacccatttcggtcgcaagcgtcggctgataaccaaccgctgacggcatgcgtccaagaagtgcagatacttcagatcctgcttgagtgaatcggaagatgttatcgataaagaacaatacgtcctggccttctttatcacggaaatgctcggccattgtaagtccggtcaaggcaacgcgcatccgcgcaccaggcggctcgttcatctgaccgaagaccattgccgttttgccgataacgccggaatctttcatttcatagtaaaggtcgtttccttcacgcgtacgctcgccgacacctgcgaatacagagataccgccgtgctcttgagcgatgttgttgatcagctcctgaatcaaaacggtttttccaactcccgctcctccgaaaagaccgatctttccgcctttgatatatggagcgagcaagtcgacgactttaatacccgtctctaagatttcaacctctgttgatagctgatcaaattttggagcttctctgtgaatcggatctttggcagcatcagccggaagcggctcatccaaatcgatattttccccgagtacattaaatacgcggccgagtgttacgtttccgaccggaacggagatcggctctcccaggtcgatggcttccattccgcgtgtaacaccgtcagttgaagccattgcaattgtacgaactgaatcatcacccaagtgaagcgctacttcaagggtaagatcgatgtccacttcattctcgttctgcgctttatgtgtaactttaatcgcattatatatttcaggcaagtgaccgtcttcaaaacgaacatctacgaccggccctaatacctggctaacgcgtccttttttcatctctatccctcctgacaaactttttctattctaaagcagctgcaccgccgacaatttccgtaatttcctgcgtgatggatgcctgacgggcacggttgtatgacagttcaagatcggcgataatctcttttgcattgtctgtcgcatttctcatcgccgtcattctcgcagcatgttcgctcgctttgctgtcaagaagcgcgccaaaaatcaagctttccgcatactggggaaggagcacttccagaatctcttcttcatccggttcaaactcaaatgacgtctttttcttgttaggcgcaatatctgtcaaaggcagcagctttttctccgttacctcctgggaaatcgcgctgacaaaatggttgtagaacagatacagttcatcaaaggtttcgtcaatatacatttgcaccgtgctgttcgccaaatctttgatttctgaaaacgtcacttcgtccctgatccccgtcatttcagaaatgacaggaattccgcgctttttaaagaaatcgcgccccattcttccgaccgcgatgaccgcatactcatctttggattgatggcgttcctgaatcctttgatacgctttgcggagtacgtttgcgttgaacgcccccgccaagccgcggtcagctgtgatgacaaggtacccggtccgcttcactgggcggcttgacatcatcgggtgtttgccggtgtatccgactgcgatatcggcaacgacttcctgcattttttccatataaggaacaaacgatttcgctttgttttcagcccggttcagctttgaagcagaaaccatttcctgggctttcgtaatttgactcatttttttatttgaagcaatcctggatttaatatcccgtaatgaggccaaaaggtttcaccacctttttgttttcaaattccttcgcattgacgtgaaaaagagagaaaaagatagcctttttctcactttttattgtttagttgcttggcgcgaacgtacgtttaaagccttcgattgcacccttcatgtcctcatcggcaggaaggtttcctgtctgggcgattgaatcgagcagatctttatgattttggtcaagatacataaagagctcttcttcaaaacgtttgatatcctcaacaggcacatcatcaaggaagcctcttgtcagagcatagagaatcgcaacctgcttttcaacgcgaagcggtttgtgcagatcctgtttaagtacttcaaccgtacgggcaccgcgattcagcttcgcctgtgtcgctttatccaaatctgagccgaattgtgcgaatgcttcaagctcacggtatgatgccaaatcaaggcgcagcgtaccggcaactttcttcatcgctttgatttgcgcggacccgccgacacgggatacagacaatcccgggttgaccgcaggacgcacgccagagaagaacaaatcagactgcaggaagatttgtccgtcagtgatcgaaatgacgtttgtcggaatgtacgccgaaatgtcgcctgcttgcgtttcaacgaacggaagtgccgttaaagatcctccgcctttggcgtcgctcaattttgcagcgcgttcaagcaaacgggagtgaagatagaatacatccccagggaatgcttcacgaccaggaggacggcgaagaagcaaggacagttcacgatatgcggtagcctgttttgaaaggtcgtcatacacaaccagcacgtgcttgccgttgtacatgaattcctctcccatcgcaacccctgcatacggcgcgaggtacaatagaggggcaggctgtgaagcggaagccgtcacaacgatcgtatagtcaagggcgccgtgtttgcgaagcgtttcgacaacgccgcggactgtcgattctttctgaccgatcgcgacatagatacaaatcatatcctggtctttctgattcagaattgtatcgatcgcaatcgacgttttacccgtttgacggtcaccgataatcagctcacgctggccgcggccgatcggaattaaagcatcgattgatttgatccccgtttgaagcggctcgtgtacggatttacgatccataactccaggagccgggctttcgatcggacgggttttgcttgtgagaaccgggcccattccgtcaacaggctggccgagcgggttgacaacgcggccgagcagctcttcgccgacagggacttccatgatccggccggttcttttaacttcgtcaccttcacggatgtctttgtaaggtcccaaaataacgatacctacatttgattcttcaaggttctgagctaagcccagcacaccgtttgaaaattcgacaagctcacctgccatacagttatcaaggccgtgcacgcgtgcgataccgtcaccgacctgaattaccgtacctacgtcgtgaacttctatttcagactgatagttttcaatttgctgttttatgagagtgctaatttcttcagctttgatgctcacttaggtttcaccccttctttcgattttcgcctgctaattgacgttctatccggtcaagctttcctcttacactgccgtcataaatgcggttcccgatgcggattttcacaccgccgatcagatccggattcacttcgtttctgacgcgcagtgaagcggcgcctgcttcttttgcaaacacttgagaaaaagaggaaatttcctcttcgctgagcggttttacagagtatacgatcgcatcttccgtcccgcggaaccggttcgccattttgacatattcgtccgcgagatccgggacgattgacgtgcggctgcggtcaacgagaagataaagcgtatgtaagactgcagtcgaaacggatccgaacgagtcttttaaaatctgctttttcttttcagcgggcactttaggatgacccagaacggcattgaggtctttatgctcaataaatatcttcttaacgacggtcagctcttcttctatttcattgaccagcttggattcaagggcaatgtcaaacagagcggctgcgtagcgtttggagacagctgattggctcatcggctttctcctacttctttaagatagtcttggatcaatttttcctgggcttgttcgtccagctctttttcgattactttagaagcgatcatcacagacaatgatgcaacctgctcgcgcagcgcggtgacagcctggtctctttctttgacgatctcgcttctggctgattctttcatgcgttctgcttcctggcgcgcagccttgatgatttcatccttttgctgttcacccagttttttcgcgttttcaatcagagactgggattcttcgcgtgcttctttcaaaagcgcctgctgctcctcaatgagcttcttcgcttcttcattctttttctcggcagaggagatctctccggtaatgtagtcttcacgctctttcattatatttaatagcggccctaaagcgtatttcttcaagagcgctaacaaaatcagcatggcaacaagctggaacagcattgttccggcgttaaaccctactcctgcacccataacctgtggtaaaaaagacatcgaatacggcaactcccttcttgcagattatctctccgaggccatcgaaaaatgttctccctcttttttcaggagggtgattcttccggccgttatgacagttcaagcaaccataaagcaatggcgaaggcctcttgcagtgatcttcgccatttaccagttttatattcgcttttagctgaagaacgctaagaacgcgataacaacagcgataatcggaagggcctcaaccaatgctaccccgatgaacataagggttctcaattcttttccagcctcaggctgacgagcgattccttctactgtacgcgatacgataagtccgttaccaatacctgcaccaagtgcacctaatccaattgcgattgcagctgctattaaactcatgaaaaagttcctcctttaaattgttatccttagcggatatgtcttatttttagtgttcatgacttactttgtgagacatgtaaaccattgttaacatcgtgaagatgaatgcctggattgtacctacgaacaagctgaacgcctgccatacgatcatcggcacaaccgctccaatggttccaaccagccccaggaaaatgctttgagaatagaagttggttgccagtccggcaagaaggccgagcagaatttcgccggcgaaaatattaccgtaaagacgcaatcccaatgttaatgtgttcgcaaattcttcaatgattttgagcggcactaaatatggaattggtctgaagaaatctttggtatactcccccaaccctttccttttcactccgtagtaatgagtgaggcctactaccatgacggcgagggttaaagtaaccgccggatcggccgtaggggatttccaccataattcgtggcctactgttatggaaaacggaaggccgagcatgttggcaacaaatatgtacatcagcagggttatgccaagggcgagaaagtctctgccgactttaagatccattgtgctgccgataatattgcgaacaaagtcgacaatccactccataaagttctgagctttcgtcggccggatcgcgagtgttcttgtggtcagcaccgctatcagaaagacgatgatgcttgtcacagtaatcattagaatgctagttaaatcaaaattgaggcctaagaaattaacaattctagattcgtgattcaaagggttttcacctctcttccattgatgaacgttttagctggataaaggaatctatcataatgacaggataaattgtcatcaaccccacaatgacgcctgccaaatgaatatattcagggtatttataagcaatggccgccgcgataatggcgttgcacaatctggaagcagtcccgagagaacggatcattttgccctttgccactgctttatcgaaggcctgcatccttttggccagcagccagagattgaaatagctgaaaacagtgccggtaatcaggcctaaaaaaattgcctgatatggcagaaatccatagcctaacacgcagactgctaaaatatataggacatatttttgttgcctacggaatgaaagactcgcatcggtcatcaaatacgctcctgatgtgaaaattttaaatctatcttacgattacggtaaactaggcggtctgaccattttacagaacgtagtgttctgctcaagacttcacacagtccgaaaattcttgggccggtgatctgtctgtcgcctgcaaatatggggttttcaaaggattttaacagaggactggtcattatgataaccgctatgaaaaccttatcataatagcctattttagcatacaatagcccccctgaggtgtcaatctgtttaaagttaaaaaactattcataatcacagcagctctcacaaaatgttcacaaattcgcctcatttaagacgcacacatgtttaattatggtataaaacacaaaaaaagaaaaccctttttcaggattttcttacattatttcgttccgaacatgcggtctccggcgtcgcccaatccgggaacgatatatcctttttcatttagtttttcatccagagcggcaatgtaaatgtcaacgtcaggatgatgcttctgcacttcgtctacaccttccggggcagcgatcagacacataaagcggatattttttgcgccgcgttttttcaagctgttcagcgcctctaccgccgaacctccggttgccagcatcggatcgacgacgatgaattcgcgttcttcaacatcggatggaagcttgacataatactcaacaggcttcaatgtttcaggatcacggtaaagcccgacatgtccgacttttgcagcaggaatcagcttcaaaattccgtctaccattccaagccctgctctcagaatcggaacaaccccgagtttttttccggcgatgacgtttgactttgccatttgcacaggagtctctacattcacttcctccagcggcaggtctcgcgtaatctcaaatgccatcagcgttgcaacctcatcaacaagctctctgaattcttttgttccggtctttacgtcccggatgtatgtaagcttatgctgtataagagggtgatcaaacacatatacctttcccatatccgtcttcagctccttttttcacacacttctattgattctacataaaaaaacagcttgtttcaacaaaaatcaggagacaattttatgaaaaaagccgccccttttcggagcggcgcaaatatcttagtaatcaagcccggtatacaacgggaatctgtttgtcagcgcttctacacgctgttttgcttcttcaagcttcgcttcgtcttcatggtttttaagggcaagcgcaatgatcgctcccacttcttcgatcgcttccagatcaaagccgcggctcgtcacagctgctgtaccgacgcggattccgctcgtaacgaaaggtttttcaggatcataaggaatcgcgtttttgttgacggtgatgccgacttcatcaagtacattttcagccacttttccggtaatgccgagagagcgcaggtcgaccagcacaagatggttatccgttccgccggatacgagctcgataccctcttttttcaatgtttcagccaagcgcttcgcattgttgatgacattttgggcatatgttttgaattcgtcctttaaagcttcgccaaaggaaacagcctttgcagcgatcacgtgcattaacggtccgccttgaattccagggaagatcgacttgtcaatttgtttcgcaaactcttcacggcaaagaatcatgccgccgcgcggtccgcgaagcgttttatgagttgtcgtcgtcacaaagtcagcgtaaggaacaggattcgggtgaagacctgctgctacaagtccggcgatatgcgccatgtccaccatcacataggctccgacttcatcagcgatttcgcggaactttttaaaatcgatggtgcgcggatatgcgcttgctccggccacgatcagcttaggcttatgtttgagcgccttttcacggacatcttcgtaatcaatatactgcgtctctttatcaacgccgtattcaacgaagttgtactgaacaccgctgaagttgacagggctgccgtgcgttaaatgtccgccgtgagcaaggttcattcccaacacagtgtcaccgtgctccaaaatcgtgaagtataccgccatgttcgcttgtgcgccggaatgcggctgaacgttgacgtgctcggcgccgaaaatctgcttggcgcggtcgcgcgcgatatcctctgccacgtctacatgctcacaaccgccgtagtagcgtttaccaggatatccttccgcatatttattagttaaaaccgagccttgagcttccataaccgcttcgcttacaaagttttcagaagcgatcagctcaatcttcgactgttgacgtttccgctcatcttgaatggcgctaaaaacttgttcatcttgcgcaggtaaatgtttcatcagcgagatcctctcctatctgtttccatttcgttaattataccatctcattgtacacggtttttcatgcaaatgtaagagattatttttaaaattcgttttttattattggaaaaaccgaatattaaacgaatagacaaatcatatagttcgatatatcatttgtttaaaaaattattctaataaagaaaaaagcctgtccggctcttccccccgcttcttccgctactccgcttcatagacggcgcggacgcctccaatcagcttcggccttgtccgcgcaagcgtcacgtgcgcttcgcctagctgtttttgagagacgcggacaggaacggcaacaggctttaaatgcattcctataaacgtgtcgccgatgtcgatccccgcatcggcctctatttgttcaacaagaacaggagccttcatatgtttataggcatatgaagccatcgatccccccgctttcgggacaggaatggcgaaaacaacgggaagacggtatgctttcgccgtttcttcctcgacaaccaacgccctgtttaaatgttcgcagcactgaaaagcgagggcgattcctgttctgtccctgagctcttccagtcctttgtagaccgcttcagcgatttgttcgcttcccgaagtgccgatgcgccttccggccacctcgcttgtgctgcagccgatgacgacgatgtggccttcgcgcaaattcgcttgctgatgaaattcatctaatatagaacgccatgtctgttcaagatttttcatgattgacgacaccctttattcatgcttgtcttcataatcggcgatttttccgatgcggacggcgtgccgcccggctgaaaactcagtcgtaagccaaacctttgcaatctctctcgctaaaccagggccgatgacccgttcacccatcgcaagaacattcgtgtcattgtgctctcttgtcattttggcgctgaaaacgtcgtggacaagggcgcagcggatgccttttactttattggcggaaatgctcatgccgattcctgttccgcatattaaaatgcctctgtcggcttccccgttcgccactttttgcgcgaccggaaacgcataatccgggtagtccacagatcctgaaccgcattcgcagccgtaatcttcgtattcgatgttcaattcgtccatcaatgccataatttcttttctgatattgattccgccgtgatctgatgcaatgattactttcattggaatgactcctcctcgtttaatgtgccgccaaaagtctcgcagaaaccgttaagccagcatacagccgttatatacttctgattgatcatgtctattgtacccgctgccgcttgatttgcaaacgctccttagccagcttctattcctgagatttcttcgcaagcatttccgccaattttctcagcagctgctccagctcatctctcgttctttgatagtcgctgagagaaccgccgaacgggtcaataatgtccccgccatctccattaacatactctttcagcgtatagatcttatcttggctctttgaaaattcatgtactgccagctgcttgtgctgctctgtcatcgtcagaacaagatcagcccattccaccttctcctcggaaagctgtgaagatgtatgattcagagcgatgtttttttcaaaaagcgcttcgacagcatataaagaagcttttccgttttcaggagcaaacaacccggcagatttgacggagacatccagatttttttcggcagccgcagatttaaagagcgcttcggccatcgggctgcggcacgtatttccagtacagacaaataatatgttcaatcttgttcactcctttgtttcatattataaaggattcagacggaaaataataaaatccgctccagaaatcaaaaaagaggggatctccccctctttttctaagttccattatgttatgcaaaacagaaaaaagattttcccatctttcaattaaatgggcagcaaaagcttcagaccgaagctcagcaagatggctcctccgagcgcttcgctgtaggcgccgagccacgtttgaaccttttttccaagcagaaggcccgcccaagttaacaccatgctgaacaaaccgaacagaaagatcgttaatatcggtttcgttccgtagaggccgaggctgagaccgactgaaaagctgtcaaggctgacgccgacggcaaaaacgaacaagccgaagccgtgcggagagatgatctgctccccgcttttattaaaagatgcgacaatcatctgaatgcccagcaccaataaaagagctcccccaatatatcccgccagcgcaccaagcgcacccgaaagaaactgtcccgcaatcattccgccaagcggcatgatgacatggaacaatccaataatgacgccgatttgaaaaacctggttccttttcagcttggccattcccattccaagaccgactgaaaaggcatccatgccgagtgcaaaagccatcatcgaaagcgtcaggatttcgcctattaacacatcaacattcatgcaattcccccttggacacgccagcttttctagcttatgcacgtccaaaggcagatagaacacccccgcttaggctacgcttcgattacgcggtggccggccgctttcaacagccggttcataatcgcccggcccactccttcctcaggaaaagactccgcaaaaataaaatcgagacgttcttcatcaaagctgcggagaacgtcatacaaaccggcggcaaccgtttcaagtcggtctcttctgccgcagatgcggacggcatcggcctgatagacatcggcccgttcctctgtcgtaaggacaccgactttcatcccgtctttctgatattggtcgatcagccgttgaatatcctcaactcccccgttcacaatagcaagaggtgcttccggtgcataatgcgtatatttcatcccgggagacataggcgcctttttttcgtcggtgaggccctggtcaatcaagacggggccggccgcttcttcgagctgctcttttgtgacgccgcccggcctcaaaatgaccggaatttcaccggtgcatgaaacaactgttgattcaacccctactcctgtagggccgccgtcaacgacacccgcaatccgtccattcaaatcgttgacgacatgctcggctttcgtcggactcggttttccggacagatttgcgctcggggcagccaccggaacgccggcctgtctaatcagctcaagcgccacaggatgatcaggcattctaaccgcgaccgtgtcgagccccgccgtcacccttgtggataacaccccgggcttgcacggcagcacaagggtcagcggcccgggccaaaaacgcttcatcagcatttctgcctgaggcgaatcaacttccgcaaattctgcaagctgttcaatttcagcgatgtggacaatgagcggattgtcgctcggccgccctttcgcttcgtatattttagctactgcttcgctgtgtttggcgtttgcaccaagaccgtaaacagtctctgtcggaaaagcaaccgtttcattttgctgaagcagtcttgccgcctgtgcaatttgtggacagtttgtggacaaatcgcgttttacatccacagtccatacttttgttttcattaacatcaaaactcccttaacaaaacactaaaaacgttaataattcatgtaaatcatgttgaaagtataaaagatgaaagaaaagaaaacaagcgttgtccacattttgtggataacgcttttgaatccgtggatatctctgtgtataagttaatggctaatttgacgttttctccattaaaaccgctccgtttacgttcagtgagtctgaaacatgctcggattcatccagctcatcaggaattgccgcagcttgtttaaaaccgagcacttcaaggaaatccatcgatgttcgcttattggctactaaataaagggtttggattcctcgcttttcgcacaatacctgcatgctttgaaacaaggaaacgatgtggccttggctgagcttgtcagacacgacaagcgagcgcagcagtccttttttgttttcaaattcctccattccgaggcaggcgacgatttcatcgggagggtcttccatcatgataaactggctcttcgcttcctcaagacccttatggcttgtccccgccttttttaaaaatgcttcgatcgcattcatgtctttcgtttccgctaacctcaattggtagaacatcttttcaccccgttttttaacttctctatccaatctatgagggcgacagtaaaatataccttttgatttggaagaatgccggctattcatttttcaattttgattagcaggaaccaacgctttgaatgagtatgcaaatgaacgctgtactggtgataagacagtttctcttctgccggcaatgtgattggcacatcagaaaggggcaaaaggtgtatatccgaaaagcagtatttcccctgaaccgttttggaaaattatatcatattcaaaagcttcaataaccatcatgaaaaaacaaacagtaaaaaaccgccctgcacacgaaagcaaggcggtccttttaagaaaaaagcccggtaatccattcgacaagaaaaaatttcacttctttgtcttctttatctttatctatgccagataccgtttcatccgccgcgtcttttttttcttcccggcggtcttctccggcagcggtttgttcgtcttcaggcgactttacggcttccccattggaaaaatcaagaaagcaaagtggcggaaacaggacgcaccaccagttggctccctctcccttgcctaatgtaattaaaacagcctcatattctccggccggatacaccatattgccgtatagctttgtcggaaatgaaacacgatcaaaacggacagacacggattgccgaacattttcgcgtttcatgacatccatggcaacctcttggatttcaggcagcttcgacctgatgacttgtctcgcttcctcaaccgagatcaggttttccacccatttcgtaatttgtttattgacctcatccctgattttgcgtttgacgctctggtcgctcccgctgtcgctgtttgccaaaatccgcagccgaatcgcttcatcaggaatcacggcaggctgcccgcctgatgattgggcagtctcttccgtcgtgagatttgcaagcgctcctattaataaaagaaaaatatacatacaggcaatgtttgatttcttcattttccccaccgttcctctcgttcttcaaccttttctagcaatattatggtcaaagatggaacggtttaaacggctgctgaaaaaaatcctactaagcttgtaatctcttcctaataaatctacatatccaaatgactctgcttgtttttttgcaggccggataaaaaaatcaccgcgctgatcgccagcagcaagccccccaatccgccgaacagcaaaaacgggaagacagcggctgcgcttgcatcaatcgcccagccgatcaagaatgaaagaagcgctcctcccagacttgcggacgaaatgaagagactcgtgatttcctctgtaaaaggctttccagccaacgaggcaagagtgacggcgcacggaaaaatgccggctgccgacagcccgatgaaaaatacgaggagcagctgtgtttgatgaaccggaaaccacgcgagaatcaaaagcaaaacagtcaaggctccggcgctgaagatcagaaagccaacggaagttatgcgtccgccaaaaatacttgtcaataaacgtccgcataccattcccgtccaaaaaaacgtgacgctgatcacgctgatttcttcagcccctttttccagcatcagcgccggcaaaaagtttgcgaaattggtctcgatacccgcatacacaaaagcgaatatgagaaagaggaaaatgtttttttctttccttccggtttcaaatatggctgatacagtcggtttttcctgataagccatctgaccggaagcagtgccgggggtttttctgcgcaaataaaccacccacatacacgcgagcacaaaaacgaagataaataaagcatacaaggggaaatgccaggcatatcgttccgtaaggatataaataagaaaaggaaacagcagcgcgcctaatccgaaaaaaacctctaaaatattcatccctttcgcatttttatcttgcgcaatcacatacgcccccatcgtcgtttctaaagtacccgcgccaaagccgagcaaaaatcccatgatgacaaaaaagatgaacatatcaaaaaggaaaacacctaaaagcgtaacgagaataagaagaaggccaaacgtcaatacagccgtatgagaggtgcgtctgacaaacatcggcgcaagcaggacgccgtttagaaaaccggtgaattggaaaaagatcaggaaggatagatcatgaagatcccgttgatattcttgaatgatgtacggtgacaggctccccagcagaatatggataacccctactagaaaataaaacgaacagccgaatagaaatatttttttcattagactcactccttcgttgcagaccataaaacccttgcggcttgggtggcacagccggcaagggtctttcgcaatgctagtttgcttgttttgaaagggacagctgctgacctttattgaaaaattcatttaagtagaactgcgtcttgtatccatcttcaaaagtggcaagagatgcaaaattgcgatcccgaattccgttcatccattggatcagctgaactctgaaggaatcggcccatccgtaaaattcattttcagggtctgtcagccacgtgtccggcattgttatcatctgctccgtcaatccggccctcagcaaaaactgatttttctgccgtgaatgatagtaaaatacgccgttttggccgttgacctcgatgctgaagccgcactcatccgattttgtgcattttgacgtaatcatattgacaaacacatgattttcaagctggccgtatacttctgaatgatcatcaacatatacctgtttttgttctttttctttgacgaccgtcatcattttgacttttaaactgtccagtttaaacgggctgtcgaacaaatagagtatgagatcgattaaatgcacgcccaaatctcctaatgccccgctcgttttgttgcttttcgaatgatcgcgccaagtatattttttcttctcaaggcgctgtttttcttaaaatggacattgatggacaaaatatctccaagttcattgccggatatcatatcttttaggcgcttaacgaatgtgagatggcggtaattgaagcccatgatcggaatataagcggattgagacgccctgcttttcatctcctccgcttcttccattgagacagccatcggtttttcacacaatacatacttccctgcagccatcgcttcaagcgcatgttctttatggcaaaagttcggcgatgaaacgatgactgccgtcgactgattcaacagctcctgcatactggtaaaggcagttcctccgtattcaaacgcacatttacgagaggcaagcgagttgatatcaaaaaacccggaaagctcggcacctttgactgttgaaagagctttcgcatgggcttttgcaattcctccggctcctataattccgattttcatctaaggacactccttatcgtttgatatgggcttttagcacttctaaaattccagccgtatagctgccttctgtcatacgggaatggagcgacttggcttctgctgtcgcattccccaccagataaccatgtccggtttttttaagcatatccacatcgtttccgctgtcgccgaaagcaaatgaattctccctctctatcgcgaatttatccaatataaaatccacaatgtacggtttgcctgtccgcaaggggataaagtccacatcatagctgttttccggatcgcctgccaaagggttgcagcgattgatatttactcctattccatgctctcttgcaagccgcctgatggcttcaagcgccctcttatctgtgctctcttccaacgatttatagtaatagttgattttatagcgggaaaagccatgctgagtctgaggcacaagcgcaatctcatattttttagagagagtctgcttgatttcttcgaccagatcatgggagaaatttgattcttgcaatcgggcttcccaatctttatcagagacttggccttcttcagagaaataagtgatttcagtgccaaggtcaccggcgacaaaatgcggaagatatcgaaagcctccccgcttcatttttgcaagaacggatgacaggctgctcccggtcacccagccgagcaaaatcttgtgatcaagatggtgcgaatgaataaatgtttcaaggtccatgagcgcttttctcgattcatcggtgatgctgtgggcgaaatatgtctcatcaaaatcgcaaaatacggcgtacttcggcttgtttacttgctgcaaggtgtgaaaagaaagtgtttcatgatacgacatcaattaaggcctccattactttgtcttgttcttctacggtgagccccggatagagaggaagctgaagcatttgtttatgcactgattcagtgaccggcagtgatgtgtgccgataattggcttttacaagtggtgtgttttgatgatgggataaaatcgggtagtatatatctgtttggacattatgaaatttaagcatcatatctttgacttggtcacgatttccgtttagtattttaattgtaaacaaatgccatacatgatcatcggtcatttgaggcaatttgatcagacctctgtcttcatactgctgcaaatgcgcaatataacgatctgctaaatataagcgcttcagattatttaaagaaagatatttcatccttgccagtccaatagcggcttgcagattatcaatcttagcgttaaagccgtagtcagccgcctttttatttttttgattcagttcaaagccgtgatacatatattccatgcatgcggatgcaaatgatggatcatccgtcacaattgcgccggcttttccgcaagtgccgagatttttatacggattgaagcttaatatggagcaaaggctgttttttcccagatcggaaacgccgatcgcctggcaggcgtcttcaataatcgggatgccgtatttatcagcggtttttgcaatggcttccatgtcaggcagctttccataaaggtgtacaggcaaaatgcatttcgttttcaaagtgacacatgcttcaatttctgaaggatccatgcaaaatgtaacagggtcaatatcgcagaaaatcggagtgcctccagctgcgagcacggcgttttctgttgcagcaaagctgtttgcaggcataatgacttcatcaccttgtccaacacccgcagccttcagcgcgacaatcatggcatcggttccgctggatgaagccatgacatgctttttgctcaaaaaagcagctatttcagcttcaaatacgccaacataaaaaccgcttgtaaattgcccggtcggcagcacgtctttcaccgcatgaaccacgtcatctacttcttcttctgtgatcagtcgatgaagcggcataaagtcaactctggagggcggggaatccattctgttcagcaaattggcggttatgtcgaattgatcctgctgcaatgtctcttttaatttttgattggccagtgtgtcgtctatacggcattcaccagcgagctttccttccttcaaatcattcagaaggacaaatagctgtttgctcgtgcaagtcatgttttcgtttgcggttttcatcaatttcaccccatttttattattttgggaaattgtcatatttcatgacatatcttaaatgatggaatcgataccataacaactctttttttcaggaagtgactttatgcctacgattgacgaaattgcaaaattaagtaatgtgtcaaaaacaactgtttcaagagtactgaacgatcatccctatgtatctgaagaaaaaaggaagcgggttttggaagtcatcgaaaaattggactacatcccgaacacgtctgcacgaaagctcagatccaacaaaacgatgtttctcgcagtgtctgtcccacacgcggaccaccccttcttcgctcagcttatgaagcatatgtccgctgaagcgctgaaacaccaatacaaagtcattgtgtttcagacgttttatcaaaagcagaatgaactgaaagtactggagctgctcaagaggaaagaagtcgacggcgttatgctatgcagccttgaaaatgaatgggaagacatcaaaaaatacgtcaaatacggtcccgtggttatggcaaatgaattccacgccgaagcggacgtgccggtgatctgctatgacgaattcgaagccggatataaaggaacggagctttttattcaaaaagggcatcatttaatggccttttgctgtgacacgatacacagcaaggcccagattatgagaaaagaagggtttatgaaagcattgtctgatgcaggtttgcgtttccaggagaagtggatgttcagccacgcatttaccattcatgacggcttccgcattatggaccagatccacaacatgtccgaaaagccgaccgccatttttacgggaaacgaccaagtggccgcaggaattattaaaagggcccgatattatcaatatgaagtgccaaagcagcttgcagtgcttggatatgacaatcaatcgatctgtgaggtgaccgatccggaaatcacgacaatcgatatacctgttgaagagctggctcaaaaagccgtatgtgcaatggtaaaccttctgaatggggaaagcggcttacagagggatgtcgtgacactgtcccctgcattaaaaataagacaatctgtttagtatatatattaatcttgaactattttttattttattcagataaaaattttgttaaaaaatggtaaagcacgccgccagaacggtcaaggctgcggttcctattttccaccgggaatttgagccgccccccttttgttcgacacacttaacaattggaggcgcagttttctaatggctaaatttacagctgaggaactaaagggtaatttgcggggaatgaagggcataaacggatcaagatcaaatgaaaaggcatgagcctggtacaataccggaatcatgccagttaaactgtttcatgacattttattgtctaacttttggagtcacttttaactatgttgttcaattaccgcgcagacgatgcggtcttttccattaagatctttcttcacccgcacgtcagcatcaggaaagaaccggtgaaacatgtctttaacggcattcccctgagtccagccgatttcaaacaccaccagtgcctgatctgcgatgacagatggaatttccttcatgaaacgcttataaaactgcaatccgtcagcaccgtccgttaaagccccggcgggttcatggagacggacgacatctgacagcgtcctcatgtcttcctcggatatataaggtggattcgaaacgatgacatcagctttcttctgtcgcgcgataagcggttcaagcaaatcaccgcagaggaaatccactttcgccccaagccggtcagcgttgtgtcttgcggtacttaaagcttgttccgaaatatccgtcgccgtgacggaaaaacgcgggctctcaagcgcaagggtcactgcaatcgccccgcttcctgtaccgacatcgacagctttaagacgatctgtcccgtgaaaaactctttccgcttcggaaaggacagcttcaacgacttcctctgtttcaggacgcggaatcagaacgtgttcatttaccgaaaattcccttccgtaaaaggactcttttccggtgatatattgaacaggcactccttgatgatgaagctcgacagattttttaaacctcgcaaaatcagactctgatatgacatcatggaagcttgccaacagtttgctgcggtcgatgttcagctgatctgtcagcaaaatttccgcggcattccggtctcttcccgcttccgtcaaataagaagaagcccacctgagggcttcaaaaattgttttcatgtttagctctccgcctgctgaagcttgcttgcctgatcctctacaatcagggcgtcaatcacttcatcaagcttgccttcaaggatttggtcgagcttttggatcgtcaagccgatcctgtgatcggtaacgcggttttgcggaaagttatacgtgcggatgcgctcagagcggtctcctgttccgacggcggatttccggttttgatcatattcagcctgagcttcctgctgaaatttgtcgtaaattcgcgcgcgcagaaccttcatcgctttttctttgtttttgatctgagatttctcatcctggcaagacacgacaacacctgtcggaaggtgggtcagacggacggctgacatcgtcgtattgacgctttgccctcccggaccgctcgatgcgaaggtgtcgacgcgaatgtctttttcatgtatatcgacttctacctcttccgcttcaggcaggcaggctaccgttgccgtggatgtatggatgcgcccgccggattcggtctctggaacgcgctgtacgcggtgtgcgccgttctcatacttcagccttgagtatgcgccgttcccattgatcataaaaatgatctctttatatccgcctgtacctgtcatattcgcttccatcacttctgttttccagccttggagctctgcgtagcggctgtacatgcggtaaaggttgccggcaaataaagcggcctcttctccgcccgctgcgccgcggatttccatgataacgtttttgtcatcattcggatctttagggatcagcaataccttcagctgatctgtgagcgactcgatttcttcctgcagttcggaaatctcctctttcaccatctcgcgcatgtcggagtcaagcttttcttcaagcatcgctttagcatcgctcagctgttccgacgcgctacgataacgtctgtatacttcaactgtttcctgtaaatcagattgttctttcgaatattctctaagcttcttcggatcgttgacaacctccggatcgcttaatagttcatttaatttttcgtaccggtcctctatcgattttaaacggtctaacacgctattcacctctgtttgctgtgcgtaacattctaattatagtatagggactcttccccgtcaaaacaacttcgccgttatcggcagcagccgcgtctttttgctatacttttaagaaaaaaggagcttgactcaatgctggaatcgattcatcacatcgccatcatatgctcggattatgaagcatccaaaacattctatgccgacaagctcggacttgagattctgagcgaaacgtacagaaaggatcgggaatcatataaactggacctctcattaaacggccgctatgtcatcgaactgttttcttttccggatccgcccgcacgccttaccagacccgaagctgccggactccgccatttggctttcacggtggccgatcttgaccagaccgtcaaggagctcaagcaaaaaggcatcactgctgaaccgatccgcaccgatcccgggacgggcaagcgctatacgttcttctccgacccggacggcctgcctttagagctttacgaagcatagcaacggctgcaccctctggggaaaaaccgctttctttgccgaatcccttcttcttttgtctaacaggaaggaggccttttcattcaggtcgaataccctttttaatgaacagttacaggttaaaaggaggtatcttatgaatactgctgatgcggcaaatgaactgggggtttcaaccaaaacggtgcagcgttgggtcaagcagctgcaactgcccgcttcccgaaatgagcttggccactactttttcacggaagacgatatcgccattttaaaagaagtaaaagagcagttgaaaaacggtacgcctatgcaggatgtcacggtcaaacgcccgaaaaaaaccttcttcatcaagaaaaacgaaatgattcaaacgaaagagcctgcactgcaattgaatgagcggctcgaagaaaggctgcagcgttttttagagcatgaacagcttgaacgcgagctgctccaaaagaaaatcgccgagctggaaagaaagctggagcaaaaagcggacgatgtcgtctcctaccagcttctgcagcaaaggcgcgaacttgaagaagaacggcagcagatcaagcatctcgagcagaaaatcagccaattggaaagcatgaaccgccgggaaaaagatacagccgtcagaagagaagaaaaaaaaccgaagagcaaattgaaatcgatcttctctttttaaagcgcaaaaaagcttgcaaggccataaacggcttcttgcaagcttttttcttacttaagctgtaattgcaatcaatatcggcagcgaaataattgacagcaccgcactgatcacaaacgcggatgccgtttccgcttcctggctttcaaagtttgtagcaatcatggccgccacagcagaaccagggaatgccacgagcagaaccgcttttgtcatgtcggcagaagaaaggccgacgaccatcgcgatcacaaacattaaagcaggctgagcagcgacttttaataaagcgatgctcaaggcaggcatactgaatttaattttgcggattccgacagtcaccccgactgcgaatagggcgattcctgaagtcgtatctccgagcatatcaagcattttctgcggcaattcaggaatttgcagaccgaataacacaagaatgatacttgcaagcggtgcaaaagcaagcggttcagacaaaccgtgtaaaattgattttcctgtcaccttccaaatgctgtccgtcgtttccgtttgtttttttgaagaacggccgacggttccgacgatgatcgcaagaggatcaagcatcgcatttacgacaattcccgtaatcgcgattggaatcgcaacttcctgcatgccgaacaggctgcccaatacaggaatacccataaaggcgaatgtcggctgtgctgagttcaatgagaacattgaagcatctgttaaatcgtatttaaacaaaaatcgtaaaagaagcaaaataataacgtaaaatccaacgataccgattaccaatgaaatcataagcggaatctggctgtaaaacttatcttttggcgttgacaaaatgcttgatacaaagtgggccggaagcgcgtatttcgttacgagcgtacttaccccttttgctgatttagcatcatagcttccaaagtgacccgcaaaccatcccagcgcaataacaaaaaatattggcgcaaggaggattaaaatatttaaaaagctcaaggctgtttcctcctctatgttgtccctttcagggacgtattaacggcggctgataaacgcggtcgccctgttacacagccgccgatcccatttttttcaaatttgattggtgcagcccggtgacaaaacatccgcacccgggctgccgtttcttttatcgtttcctcagaacctaatattagtcttgttttgcaacaattgttttatactccggacgccacatggcttcgcggacagccttttcgacatcttcaggctgaacttgggccacgccgtctttaatggcagcttttacaacgtcgatcgccacttgaacggatacgtcttgcaggtcgtcgattttcggcagaagacctgcacccggcttttcatgatccaccatgttcgcgaccgcgttggcagatgcagcaaacatgccgtttgtgatgactttcgctttcgcaacgattgtacccaggcctaatccagggaatacaaaagcgttattggattgtccgatttcgtgtttcacgccattgtactcaacagcttcaaacgggcttcccgtcgccacaagcgcttttccgtccgtccatttgaacaagtcttcaggaacagcttcggccagatgtgtcggatttgacatcggcagaatcacaggacgctcagtatgagccgccatctctttgatgatttcttcactaaaggcgccggcaacacctgatgtaccaatcaggatcgtaggcttcacttgacggatgacttcctcaaaggaaatctctcccttttcattgcgtttccaatctttcacttcttccgtatcgcgcaaatacggttcttggaaatccatgatttgatccatgcctgtcgttaataatcctctgtaatcgactgtccagaatgcacggttggcttcttcttctgaaagcccttcaagcaccatggtgtcgcggatttggtcagcgattcctataccagcagaaccaggtccgaagatgacgacccggtggtctttcaaagacgtgccggtctttttgacagctgctaaaatcgcagccagcgtgatagcccctgttccttgaatatcatcattaaatgttgcaattttatggttatatttactcatgatattgcgggcatttttatttccgaaatcttcccagtgtagaagcgcgttagggaaaagcttcaatgctgtttcgacataagcgtcgataaattgttcatagcgctcgccttctacacgcggatgacggtttccgatatagagcggatcgtttagcagtttttcattattcgttccgacatccagtacgaccgggataacgcggctcggatcgattcccgctgccgccgtatatactgcaagcttaccaatcgcaatattgatgcctccgacgccccagtcgccgatccccaaaatgctttcggaatctgtagcgacgatcaaatcgatgtcatcagcagacgcctgcaggtttttaaaagccgtttcgattccgtccatatcatcgattgacaagtaaacgccgtgcggtctgcggtattcgtggctgtattcctgaatcgcttcgccgacagtaggcgtatagacaaccggaagcatttcacgcaggtggttttgcaataatttatagaaaagcacttcgtttctgttttgcagatcgttcaaatatacgttttggcgaagtctgtcaggttgacgggaaaattgttcgtaagcccgttctgcctgctgatcaaggctgagaacagtcggcggcagaagcccttctagaccgaggttctttctttcttcaagagaaaatgcaacacctttatttagcgttggaatggaaagaacgtctttaccccgcaaagaagtctccaaatgtccttccttcgttcttctcatgttgttcacactaattaccttctttcttaaaatgttaatgaagtgaaataaatacggtaaacaatatagaatatttgcctttttacacatgtagatttgtcaaatatgtaacgcgcgttttttgacaaaaaactgaacatttcctaaaacctatttactttttactgactacagtaagtcattttatgcctgcttttgtcaaaattcaagcgatgaaaattagttaattttttcgtattcttaattaagttttttaattacattaattcccgcaaaaaggattcaataaaaaaaacacttgtttttaccaagtgttttcgagtgaaaatctatatgtttttccgatttcatttcgggtttccaggcacttcatgatggtggcggcagcgcgcttcatatgcttcggaggccccaaccaaaatgaccggatcgtcataagaagcaggttttccattgatcagcctctgcgtgcggctggctggagatccgcagacagagcacacggcttgcagcttggtcaccgtttccgctaaagccatcagatcgggcacgacgccgaaaggctcgccccggaaatccaaatcaaggcctgctgcaatcacacggtagccctgatcagccagagaagttaacgtgccgacaatcgtttcgtcaaaaaactgcacttcatcgacgccgatgacatccgtttctttgcttatgtattgaaaaatttcttccggagatgcgatggcatggcacacaatggatgtcccattatgcgatacaaccgattcgctgctgtagcgattatcaatggctggtttaaacactttgacttcctgcttcgcaaacgtcgcccttttgatccggcggatgagctcctctgatttgcccgaaaacatgcttccgcatatgagttcaagccagccgctttgcttcatgatgtacatccaactaactcctctccagcaattattgcaagtaaaaaacaggcaagaagaatccctgcctgtttatcatatctattattacttaagaccgtattttttgttaaagcgatcaacacgaccatcagcagaagcgaatttttggcggccagtgtagaacggatggcattcagaacaaatctcaacgcgtacctcttcttttactgaacctgtttcaaattcgtttccacaagcgcatttgactgttgcttttttgaactcaggatgaattcctgctttcatgtctgtcatctccttccgccctgaatccaattcggaaacagagttattattccggggcaaaacctccggaacgcacatgatagaattataacagcgattcggacgttttgcaaactaaagttttaaatcagcgccttgcagcagacatattggcttgtttccattcctggatcagaatatcgaaaaactcctgattcgttttcgtctttttcatttttctcatgaatttctcgacgaagtcaggcgtgtcagacatcgttttccggattgaccacagacgatcaaggtgctctttcggaacgagaagctcttctttacgcgtacccgaacggcgaatatcaatggcaggaaagattcttctttccgcaagagaacggtcaagatgaagctccatgttccctgttcctttaaattcctcatagatgacgtcatccatccgcgagcccgtgtcgacgagagcggtcgccaggatcgttaagctgccgccctcttcaatgttgcgggctgctccaaagaaacgctttggacggtggaaagcgccgggatcgattcccccggacaatgttctgccgctcggcggaatgacaaggttataggcgcgggcaagccttgtaatgctgtccattaaaatgataacgtcctttttatgctcaacaagcctcattgcacgttccaatacaagctcggccaccttgatatggttttcaggaacttcgtcaaacgttgagctgacaacgtctcctgcaaccgaacgttcgatgtcggtcacttcctcaggtctttcatcgataagaagcacgatcagctccgcttccggatgattggttgtgatgctgttcgcgatctctttcaagagcatggttttacccgctttaggcggagcgacgatcagaccgcgctgtccaaagccgaccggcgccatcatgtccatgatccgtgttgacaggtgattcggcttcgtttcaagcaccatctggcgatctggataaagaggcgttaatgccggaaagtgcacgcgttcttttgctgattcaggatcgtcgccgttaaccgcttcaacgtgcagcaggccgtaataccgttcgttttcttttggagggcggacctttccggacactttatcaccgtttctcaaatcaaaacggcggatttgtgaggcggaaatatagatatcctctgaactaggcgagtagttgatcggtctgagaaagccgaacccttcggactggatgatttccaatacgccttccatgaacagcagatcttcctgttcggcgtttgctttcagaatggcaaaaatcagttccttttttgtcagtttgctgtaataagagactttataatgccttgcaagctcatacagctcttttaatttcatattttccaaagatgaaatggatacatctttcactaagaacaccactcttttctaatcgaataatttactttgtctcatcaatttcacgaaagacgattaatgtatactgccgattcgttttaccggcaacgcttctacccatatatatcgacgtattgaaaaggattataagtatgagtcgagaaagaagcgaggacttaacaagagaagataatcgcatatctgatagatgcggcaggattttggttctctctaggaaccagcatgtgcagaaaatttcgcagcactctttagttttacctcatttgtcgtacatattcaacttcatttatgatttgacatgaaattgatagagatgaccctgttttgaaaaatgccttgacatgaagaagaaaagccgttagctattgtatcagagtatgaaccttgattcaattcgtgaagtgaaatacaagggaaaagcgggtcgtttatatccccgcttttccttttccttatggccggatgactaggttaggttttttcttgagactgtgtcttccgtccacaaaccgtaccgtaccggattttgccctcatgactacgctgtgggtcgttccaacagatcctttgaattgcacgcctttcaggagctctccgtctgtgacgccagttgcggcgaaaatcgcatcgtctcctttgacgaggtcttccatgcggagcactttgcccgtatcaagccccatcttttcacagcgtctcagttcttcctcactttgaggaagaagctttccgtgaatttcccctccgagagctttgagtgcaacagccgagagtacgccttccggagcgcctcctgagccgaataaaatatcgacgcctgtatgatcaaaagcggtgttaatcgcaccggccacgtccccgtcattgatcagcttgattctggcgcctgcttcgcgaagctcatggatgattttctcatgccgcggacggttcaaaatcgtggctacaacatcttccacatctttattctttgcttttgccacagctttcaagttatcaatcacaggcgcttcaatatcgatgcagcctacagcttcaggacctacagcgattttatccatatacatgtcaggcgcattcagcaggtttccgtgatcagccaccgcaatgactgcgagagcgttccatccgccgctagcgacgatgttcgtcccttcgagagggtctactgctacgtctactcgagggccgtagccgttgccgagcttttctccaatataaagcatcggcgcttcgtccatttccccttctccgattaccaccgttcccttcataggaatggtgtcaaacacatccctcatggcgcttgtcgcagcgtcgtcggcttcgtcttttttacctcttcccatccagcgcgctgactttagcgcagccgcttctgtcacacgaacaagttccatcgataagcttctttccattcctatctaatctcctctcacccatatgaaatcgttttatgttttatctataacagcatttgtcgatcacgagttttgcagctgttcaatttcctggtctgtcaatttttcgcgccagacagtggccccgagctttgtcagcttttcttcaagctgactgtagcctctgtcaaggtgctccaaaccggtgatttccgtgacaccttccgccattagaccggcaacaacgagacatgctcccgcccgaagatcactcgctttcaccttggcgccctgcaaaggagctggcccggtaatgatcgccgatcttccttcaaccttcatcgacgcacccatgcgtctcagctcgtcaatatgtttgaagcgagcggagtaaatggtgtcagtgacaacgctcgtcccgtttgccttcgttaaaagcgatgtcatcggctgctgcagatcggtcggaaagccggggtatacgagcgttttcaaatcgaccggtttcagctctttctgtccgccgaccattaaaatctgctcgctgctttcttcgattcgaacccccatttcgcggagcttggcgattaacgattccaaatgcgtcggaattacattatcaatcagcacttcttgtcccatggaagcagctgcaatcatgaaagtgccggcttcgatccggtccggaataatcgagtgtctgcacccgtgaagcgattcaacgccttcgatgcggatgacgtccgtaccggcgccttttatttttgctcccatgcttgttaaaagagtggcaacatcgataatctcaggttctttcgcagcgttttcaattacggttctgcctttggcaagcacggcggcaagcatgatgttgatcgttgctccaacactgacgacatcaagataaatgcgcgcgccttttaattcctccgcacgcagatagatcgcaccctgttcgtttgtcacttcggctccgagcgcctcaaaacctttgatatgctgatcaatcggtctcggaccaaggtggcagccgcctggaaggccgatgaccgctttcttaaagcgtcctagcatcgcgcccattaagtaataagaagcccgaagctgtttcacttttccattcggcaaaggcatgctgatcatcggcgcaggatcaacgaccatttctcccttttcaaagtgaacgtttccgccgatctctctcagcagatcgcgaagcgtcaaaatgtctgaaatatggggaaggccttcaagcgtaaccgtcgaatcagccaaaatcgtcgcaggtatgagagcgacagcgctgtttttcgctccgcttatatgtactgtgccattgagaggatcgccgccagctatatttaacttttccatgatcgtctccttccttaaagaagatagctaatggagcgcttcataatgagatttccttcaaactcaaaataaatggttcatttcaaaatctatccaattaaaagagaaagaatacaacacatttcaaatttatcgggaagaaaagtagcgaagcagactgcggcaaggttctcttctgcaaaacattcatttctctttgtaagacaaaatggtgacaaacggagggagtccctccacttgccacccacatgaagcaattatttattccagtcagccaaaaactgttcgatccctttatcagtaagcgggtgctttgtaagctggtgaatgactttgagaggcatcgtgccgatatgagctcccctgagcgcggcctcagtcacatgctgcgcatggcggatggacgcggcgatgatttgcgtgtccaaaccgtgcacatcgaaaatttgtttaatttcactgatcaagtcgaggccgttgtggccgatatcgtcaaggcgtcccaggaacggggaaacatacgtagctcctgctcttgcggcaagaagcgcctgatttgcgctgaagatcagtgtgacgttcgttttaattccgagatcggttaatgctttaacagctttcaggccgtcaggcgtcatcggaattttcaccgtaatattcggcgcgattttcgcaagctcttttccttcttcaatcatctcttcagccttcagagaaataacctcggcgctgactgacccagaaaccacttcggtaatttcacgcagacggtcatgaaacgaaatgttttcttttgctactaaactaggatttgtcgtaactcccgcaagcacgccgagagcgtgcgcctctttaatttcgtctaaatttgcagtatcaataaaaaacagcatattgataaaacctcctgtcatgaaaatgtctgaactgtggaacttgtttgcgctttccggatgatatggataaaaccgcctgtcgctatcaggcggcttttttgactgaacgggaagcaaaagagcctcatgccgtcacatggcatgtgttaacagcacttccctctaaaacaccagaaaaacatcctgtttccccggctttgcgggaaaacagatgcttttccaatcgtcattatgctttgtttgaagaaccaaattcgcgcattttgccgataactgtttctttgatagcttcgcgtgcaggtccgaggtatttgcgcggatcatactcttcaggcttcgcagccagcgtttcgcgaacagctttcgcggaagcgatttggttttcagtgttgacgttgatttttgccgtacctaaagaaatagctttcttaatgtcggcagtcggaatgcctgtaccgccgtgaagtacgagcggaagaccagttgtatttccgatttcttccatttctttaaatccaaggtttggttcgcctttgtaaggaccgtgaacagaacctaatgcaggagcaaggcagtcgattcctgtgcgctcaacaagctcttggcactctttaggatccgcgtagatgacgccatctgcaattacgtcgtcttcctgtccgcctacagttccaagctcagcttcaactgatacgccgtggaaatgagcgagctcaacaacttttgaagtcgtcgcaacgttttcctcgaaaggatggtgagaagcgtcgatcataacggaagtgaatcccgcatgaatcgcttttgcacaggattcaaagcttgaaccgtggtctaagtgaatcgcaacaggcactgttacgttgtattcttccatcagcgctttaaccattgcaacaacggttttaaaaccgcccatatagcgtcccgcaccttctgatacaccgaggataacaggagatttctcttcttcagcggcttgtaaaatcgcttgagtgaactcaaggttatttaagttaaattgtccgacagcatatccgttttcttttgctttattcaacatttccgtcattgatactaaaggcatgtcgaaagtcctccttatgtagcctgatttgcttttgcgaaaaaagcctccacacctacctagcatgaccagaaaaatccgccatatgtaaaatgttttgttttttaaaaaacgttagacagcttttctctacttatatagaataacaattaatcaacaaatcggcaacattgtgactgtgacaacatcaaaaacttttccgctatccgttggactttatgggcagatacgttttgacggcatcgcggatttcgtcgatgtcaaaaggcttagcaaagtgtgtcagggctccgagctccttcgattcctggatcatgtcgagctctccgtaggccgtcatgatgatgacgcggatcccctcgtctatgatcttcattctttttaaaatttcaattccgtccattccggggattttcatatcgagcagaacgaggtcggggcgctggtttttcacaatgtcaagcgcttgaatcccgtttgcggcctggaaggttttgtacccttctttattgaaaacttcattcagcagaacccgaatcccgtactggtcgtctacgattaaaatcttctcattcatgatttacacctctatatttataattttcgccaaaattaagcagtagtttatctattctgttttgtttttcccttttcctttaattaaaatatttaagtttgcgacatatttagaggatttttcccattattctcttttgttatataatgatagtcagtaaaaaaggaggagtcaccttgcttaaaattttcaccactcaattgacgggaatcttcaaccggattcaagagggcgaggcccaatcgatagaggacggcgcccgcttgttggctcaggcggtcatcagtgatcattcggtttatgtatacggaaaaaatgaattggaaggcattttgaaagaagcgatgtacagttctgaaccgttcccctcagtcaaaccgctgcagaaggacgaagaaaactggcccgattttgaaatgacggacaaagtgctgatgttctgcgccggttcagcggatgacgaagaactgaaaatggcggaaaaactgtatgaaaaaggaatcggacttgttgtcgtctccccttcgggaaaagacggcgtcccgatcgcatccttcgccgatgtccatatcgattcaaagctgagaatgccgcttcttcccgatgaagacggaacaaggtacggatttccgtccctgatggtcagcctctatatttatcatgccctatcctttacattaaaggaaatcctccaagaataccaataaaacagggttgcctaaaggaaattagtgacgtgaggccggcctaatgaatatagtaccagttcgggccgccattatcatcagaaagagcccaaaaaagcccgccggcgtgatttgccggcaggctttttcttttttacagcttttccgaagtctttagcgaagcatgtacgaagtctctgaacagagcctgaggtcttgtcggtcttgacgtaaattcaggatggaactgagacgcgacaaaccatggatggtctttaagctcgataatttctacgagacggccgtcagggcttgtcccggaaaatacaaaaccggcttcttccatctgctgtctgaactcattgttgaattcgtagcggtggcggtggcgttcatacaccacttcattttcatatgcctgatatgctttcgatccttcttgaagcttgcacggataaagtccgaggcgcagtgttccgccgaggtcttcaatgtccttttgttcagggagaaggtcgataatcggatacggtgtagacggatcgatttcggctgagtgcgctccttcaaggccgagcacgtttctcgcgtattcaatcgatgccacctgcattccgaggcaaatgccgaagaacggaatcttttgttcgcgggcatatttgactgtcgtgattttcccttcaacaccgcggtctccgaatccgcccggaacaagaataccgtccgcattttgaacaagatcggcaacgttgtcttccgtcacttcttccgcattgatccatttaacttgaatgtctgcatcaaacgcataacccgcatggcgaagcgattctacaactgaaatgtaagcatccgggagctcaacgtatttaccgaccaaagcgattgttaccgttttggacagatttttcacctttttgacgagttctttccactcttccatatcggcttctctgcaatccagcttcaagtggctgcaaaccaggctgtccaggccttgtttttgaaggtcgagaggaatggagtagagcgtatccgcatctccagcctcgatgacggctttaggatcaatgtcgcagaagagcgcgattttatctttcatgtcctgagaaatcggcatttctgttctcacgacgatgacatttggctgaatgccgaggctgcgcagttcttttacgctgtgctgagtcggctttgttttcatttctcccgccgctttaagatatggaacaagcgtacaatggatgtacatcacattgtcgcggccgacatcgctcttgatctggcggatcgcttcaagaaacggcagcgattcgatgtcaccgacggttccgccgatttcagtgattacgacatcagcgtgcgtttcttttccggcgcggaatacacggtctttaatttcatttgtgatatgaggtattacctgtacggttccgcctaaataatcgcctctgcgctcttttttcagcaccgtggaatagatttttcctgttgtcacgttgctgtatttatttaaattgatgtcgataaagcgctcataatggccgaggtcaagatccgtttccgcaccgtcgtcggttacaaacacttcaccgtgctgatacgggctcatcgtacccgggtctacgttgatatacgggtcaaatttttgaatggtgacattcaaacctctgttcttcagcaggcggccgagcgaagacgccgtaattccttttccaagcgaggatacaactcctccggttacaaagatatattttgtcatttctgtacccctctcttcgattaacgcttatttcttaaaatgctctttttatgaaaaatcatttagatcttttctaaatgatttaaatgattaggaggcggaaaaacaagaaagctccctttcaatttcttgaaagggagctgatagtccgtatcactcgaatctcttcgttttgaagagcccaaaatacatactacctagttcgcctgtgaaagtcaagatcgatttaaacatgaattccgttcagaaggcaattactcttcgtcttcctcttcatcaaaatcttcatcatcatccaggatctcgtcttcaagatcatccagctcatcatcgtcggcttcatcgatttcatcgaattcatcggcgtcaatgtccaaatcttcttcgacatcgtcaagaagaatatcatcctcgtcgatttcttcgaattcgtcaagatcaagatcttcttcaaccgcttttttcgcttttttctttttcgcttttacagtcggctgggtttcttcatcaagctgatcatacggataccagctgcgcaggccccacgtttggtctgacagcgccaaaaagcgtccgtcgatatttaaatctgtgtagaactgggcgatgcggtcttccagctcttctttccccattccaagcaaggaagccacttgatctgttagctcctggaatgtaatcggttttttgtgttccgagaaaatttcgtatgcgatttcaactaaagccatttcctttagctgctcctctgagtattgtttcaaactcatcgccagacactccctttctatcttcatgtatgtatctactatctctgtcatagaaaataagcatgtaatccctgtctttacgacaaaccatacctttcattataaacaaaagaaatcactttatgccacctttattcccgttaattcaataatttttgccggttgcattggaaatcggcggcaagcgggattgaaacatagaacagccgggagcgtccggccccttcaaaacaaaaaaactgcgccggcagcctgtccgccggcggcagatcaagccgggccagacggcgattttccacccttatttcatcagcattctcgaaatgacgagcttctgaatttcctgcgtaccttcatagatctgtgtgatttttgcatcgcgcataaagcgctcgaccggataatcctttgtgtagccgtacccgccgaatatttgcacggcctccgtcgtcactttcatggccgtatcccctgcgtaaagctttgacatggcagaagcctttccataaggcagtccttctgattccagccatgccgcctggtaggttaaaagccttgaagcttcaatctccgtcgccatatcagccagtttaaaagcgatgccctgctgctcggcgatcggcctgccgaattgcttccgctctttcgcatacgccctcgccgcctcaaatgcgccctgggcaatcccgacggcttgagcggcaattccgtttctgcctccatcgagcgtcttcatcgcgattttaaagccttcaccttccccgccaaggcggttttttaaaggcacgcggcagtcctgaaagatgatttcggttgtcggtgatgaacggatgcccagtttcctctctttttttccgacagaaaagccggggaagtccttttcaacgataaaggcggttgtgcctttgtgtttctgttccggggcaaggttggcaaacacgatgtagaagtccgcgattccgccgtttgtgataaagatcttcgtcccgttcaaaatatattcatcgccttttttttctgcggtcgttttcatgccgccggcatcggagcctgaaccgggctccgtcaatccgtaggctcctatcttttcgccgcgggccatcggctttaaatattcctgtttctgttcttctgttccaaatgcataaatcggccagcccgcaagcgatgtatgggcagacaaggtgacacccgttgaggcgcagactttcgaaagctcttcaaccgcgatgacgtaggcgagatagtcgctgccgattcccccgtattcctctggccacggtatacccgtgagccccaattccgccatttttgcaaacagttccatgtcaaaccgctcttcctcatcccgctctttcgcagtcggctccacctcgtgatgggcaaagtcgcgcaccatcttctgtatcatttggtgctcttcactcagcttaaagatcatcctttttccccctttgacaccttataaatgtttaccgatgacgatccgctggatctcgctcgtgccctcataaatttcacacactttcgcatccctgaaatatcgttcagcgctgaaatcctttgtgtatccgaaatctccgagcagctgcacggcctctccggcgacatacatcgccgtttccgaagcgaacaatttggccattgaagcagctttccccgtctgcatgccttgctgtttcaacgaggcggcctggtagacgagaagcctggccgcctctgtcctcgccgccatgtcggccagcttaaaggcaagcgcttggccgttcttatacagctctccgtccggataccgtttttttagaaattgaacggcttcagaaagcgctccctcggcgatacccagagcctgcgccgcaattccgatccggccggtatccaggttggacagggcaattttgaatcccattccttcctcccccagcagctgccgggcgggaatgacagcgttatcaaaatttaaagtgaccgttagcgaaccgtggagccccattttctcttcattttttccgatgaaaaagcccggcgtgcccttctccacgataaaagcggaaatgcctcccgttcccgcctccggatcggttgaagcgaaaacaagataaatgtccgcggctccgccgtttgtaataaaaactttcgttccgttcagcacataggtatcgccgcgcttttcggccctagtttttagactgcccgcatcggaaccggcactcggttcggttaaacaaaaagctcccaagtactgccctgctgccagctttttaacgtagtgctctttttgccgctcattaccgtttaaaagaatgggaatggtgacaattgacgtgtgtacagatagaaccgcaccaagaacggcgcttttctttgacagctcatgtatggtcatcatataggtgataaagtcatgaccggccccgttgtacttagccggtatcggaagccccatccagccgcgctccgccattttcttcaaaagagaggttggaaaacggcctttttccatttcaggtacaaaaggagcgacctcctgtttgacaaaatcccttacaaccttctgcatgcgggtctgctcttctgtaaactgaaaattcaagctcacccctccttatgtcggctgcttttcatacgtataaaaccctctgcccgttttctttccgagtcgtcctgcgctgacatattgtttaaggagcggacaaggcctgtacttatcgtcgccaaagccttcatgcagcgtctccataatatacagacacgtatccagaccgatcagatcggcgagagccaacgggcccatcggatggttcatgccaagcttcatgattccgtctatgctttctttctcggcgatgccttcataaagtgcaaaaaccgcctcattaatcatcggcattaagatgcggttggagataaatcccgggaaatcccgcacctctatcggaaccttgttcatccgctccgccgcagccacgacggtttcatatgtttcgccgctcgtctcaagccccctgatgacttcgacaagctgcatgacgggaaccgggttcataaaatgcatgccgatgacgttatgaggtttttttgtgacggcagcaagttccgtaatcgacagggacgatgtatttgatgccaatatcgctgagtcttcggtcacttcatcaagccgcgtgaaaatgtctttttttacgtccatttgttcaacagccgcttcaatgatgagaaaagcttcccgcgcttcgtcgagcgcagccgacggagaaaggcgctggtagatttgcttcacatcttcatgcggcagcttgcctttttccgcctgtctgaaaagctggccggaaatgcgcttcattcctttttcaatttgttcaggtgatacgtcatacatgtaaacattgtatccggcctgggcagagacctgagcgatcccggaccccatctggccggctccgatgaccatgatcgtgtcttttttcatctgaaatccccctttttatacctcgatcatcacggcgtctccctggccgccgccgctgcaaatggcagcaatccctataccgccgccgcgccgttttaattcgtacataagcgttaaaatgattcttgctccgctcgcgccgatcggatggccgatcgcaatggcgccgccgttgacattgaccttctccatgtcaagacccgcgatctttccgcttgccaaagcaaccgcagcgaaagcttcattgatttcaaacagtttgatatcagaaagctcagctcccgttttgttaagcagttctctgatgacaagcccgggggttttcggaaagtcttttgcttcgactgcaattgatgtgtgcgctttaatgacggccggcgccttcacattgagttcctttgccttgtcttcattcatcacgataagtgagcatgccccatcatttacccccggcgcgtttcccgccgtaattgtcccattatggtcaaaaaccggggcaagctttgacagcctttccattgacgtgtcgcgccgcggtgcttcatcttgatcgaccgttaattcgccgccccgcttctcttggatgctgaccgggacgatctcttctcctagcgcgcctgaatccgcagcgtgtacggctcgcatgtggctcctgagcgcccaccgatcctgctcttccctagcaatctccaactctttcgcagcggcatttccgtaggagcccatgtgaacgcccgtaaatgagcatgtcagcccgtctgcgatcatcaaatctttaaccgccccgtctcccatcctcagcccccacctcgctttttgaagcaaataaggggcgtttgacatcgattccatacctccggcggcaatgacctccgcatcaccggccctgatgatctgatccgccattgtgacgcttcttaaacctgaagcgcacactttattaatcgtttccgttttgacgtcccacgggagtcccgcaaaacgcgcggcctgcctcgacggcagctgcccctgtccgccttgaagtacggagcccatgatgacttcatcgacatcctcaggatttacaccggaacgttttaatgcctcttttacggcgattccgccgagctccgcagccgtctttgactgaagcgcgcccccgagttttccaaaaggcgtgcgtgcgccgcctgcaataactgatctcgccacctgacatcctctccccttatcatgatttgtacataccgaagataaaagaaggcggagatccggctcacaccttctttatttaaaacctgaaatccgtctatgaggcatgttctttttgctctgacccgaatacggcgcgttcaagcagctccgctacatcatacgtgccgacctgatcctccaattccttggcttttgttccgtcgccgagcatcgtcaaacagtaaggacagcccgagctgatgacagaaggtgatgtgctgagcgcctgctccgttctggcaacgttgatcctcgcgcccgcctcttcctccatccacatgaggccgccccccgctccgcagcacattccgttttcacggctgcgctccatttccgctaaacggatgcccggaatggagcggagaatagcgcgcggcggatcgtaaacctcgttgtagcggcccaaatagcatgaatcatgaaaggtgacggtttcgtgaaccggaaactcaggtttcagctttccttcttcaatgagggcagcaagaatttctgtatgatgataaacttccgctttcagaccaaaatcaggatattcatttttgaaaatattgtatgcatgcgggtcgatagttacaattttttgaacatcatttttttcaaattcctcaatgttttttgcagctagctcctggaataaaaactcgttgccaagccgtctcggcgtatcgcctgaatttttttctttattgcctaatatcgcgaacgtgaccccggcttgattgaggaggcgagcgaaagccatggcgatcttctggcttctccggtcatacgatcccatcgacccgacccaaaacaggtattcaaaggactcgccttttttcttcatttcttttactgtcggcacctcaacatcgtctcttatatcacgccagttttcacgttcttttcggtttaatccccaagggttcccctgcctttcaatgctcgtcatggcgcgttgggcatctgcatccatttttccttctgtgagcacgagatagcggcggagatcgatgatcttatcgacgtgctcattcatgaccgggcactgatcttcacaattccggcatgttgtgcaggcccaaatttcttcttctgtgatgatgtcgccgattaagctcgggttgtaaagttctgaagcagccgcttcccttgacccttctccccctgccgccatggccagctggttgcctttcgtatgctgaaagagcggtgcgggtacccaaggcgttctcgatgtcactgctgctcccttttctgtcaaatggtctctgagccgcaaaatcagatccatcggcgaaagcatcttgcctgttcctgtagccgggcacatattggtacagcgcccgcattccacgcatgcgtaaaggtcgatcagctgggactgcctgaattcctcgatccgtccgacgccgaacgtttcttttgtttcatcttcaaaatcgattttttgaagctttcccgggtttgtcagccggctgaaaaatacgtttgccggtccggcaattaagtgggcgtgctttgactgcggtacatagactaaaaatgtcagcaggatgagaaggtgcgcccaccacgccgcgtagaacactgccgctgaagcggtttcccccataaagccgaaggcaaaagcgatgcctgatgccatcggttcgtgccatgataatgaatgttcatgccagatcatgttcataccgtttccgagtaaaacggtaaacatcaagccgccgatcagcatgagcacgatccccgacttaaaattgcgcttcagcctgacgagtttttctatataccgcctgtgaaaagcccagactaccgcaattaaaatcatcagtgtgacgatttcctgaaaaaacgtaaacgccgggtagacgccgccaagcggaagaccttgatcaggaacgagccctttcaaaataaaatcgatcgctccgaactgaacgagaataaagccgtaaaaaaacatgacatggatgatgccgctttttttatctttaagcagtttcttttggccgaacacgttctcccatatcttttgaaggcgctccttcgtccgcttatcaaaatcctctttttgtccgagcctgatgtaactgattctcgttctgatcaaatagacgaacagataaacggcgtaaacggttacacctaaaaacgcaatgaaattcaacgacagcaagacattcatcagctgctccccctttcatttccccaaccttaaatccccttgaactacctttatcttaaataatgaatgagtgttcagtcaatatattttcataaatgcaggaaaatagggggacactattctttacacgaaaaaagggagtgtcttcattggtgccgcttatgattatggtatgttttctcatcctgcttcttgcgctcgatttccattttggccgcaaagcctttgagaagaaagcctacgagcccgttttttcagagaagaaaagcgatattgaactgattcataatggagaagacttgtgtgagcggctgctggatgacatccgccaggccgaatcgtcggtgcatgtcatgttttatattgtgaagaacgatgacatcagccttgaatttttgaaggtgctgaaggataaagcgaaatccggcgtatgcgtacgattgctgatcgaccggatcggcgcgatgaaggtgaagaaaaaaacgctctccggcctgaaacaaagcggtgtgcacgtttttttcgccaacaagccgggcttcccctatttcttttaccggctgaatgcgaggaatcatcgaaaaatcgccgtcatagacggaaagatcggctatgtgggcggatttaacatcgcgaaagaataccttggtaaaaaagcggaattcggaccgtggaaggattaccatttgcgaatgacgggagaaggcgttgccgacttgcagcacatttttatatcggacttcaaaagagaagcgccgcaggcaaagccggccaacagcgtatttccgccgctgcagcaaggagctgtcacccatacaacccatgcgacaaagggattttctctagaggaaaaatacatttcatttatcgaacaggcaaaagaaagaatcatgatttgcacgccgtactatattccgagcccggctttgcagcaggctgttctctcagccagggaaaggggcgtgatcgtgtcggttctcgtgccgatgaaacccgatcatccgcttgtcaaagaggccgcctacacgcactttccagcccttttaaaagcgggctgctatatttaccggtactacagaggcttttatcatgcaaaagcattaatcgtcgatgaccggcatgtgatgatcggaacatcgaattttgacaacaggagcctgtttctcaatgatgaagtgaatgtcgtcatccatgataaagactggacaaagcaattcttcgacgtcgtcaaggaaagcattgaacacgccgagcttctgacaaaggagcggtatgcgaagcggccggtgatgcagcggcccgtcgaatggctggcgaaatcgatttcattctttttataaaacgtacgtttatcctgcatgacatgcgggtaacatttcaccaaagtgatgattacatacggaggggatgtacgatgaaccaagcagagtcgattaaactccgcgcccaatcgatgacgttaaaaaacttgattgagctgtacaagctttgccgctcagccagacatcagctatatatatgctcaagaaaaacgatgtgcaaaatcaaagatttaattgagctggaaatgttcagaatggccaatcgcgaaaatgagtgcctgattgtcatcgaagggaaaatggcgcaggaattagtaaaaaaagcacaatcgattctttctgacgctcaagttcaataagggaaggcggaagttcttcctttgcgagacgcctcctcaccaaatcaagaaaaaatcccccgttcaatggacgggggattcgttttacattttttcaggcgctgatacgccgatcagcttgagggcattatttaatgtgatttgcgttgctttcatcaatgataaacgggcccggcttttttcttcatctgccggatcgaggactttctcagcattgtaaaagctgtgaagcacagatgccaattcaaaaatatagtttgtaatgcggtgcggaatccgcttctctgcggcatcagcgacggcctcagggaacgagccgatcactttaagcagatcatactctttctcagaaccgatcttcgtaagatcaaggttcccttcaaaagaaatgcctttttcttcgccttggcgcagcatgctgcaaattctcgcatgggcgtactgcgcgtagtaaactggattctcattagatgttgagacggccagatcaaggtcaaagtccatatgggtatcggcgctgcgcatcgcaaagaagtaacgcacagcgtcaaggccgacctcatcaataagatcgcgcattgtgacggcttttccggttcttttgctcattttcattttttcgccgtttttgtaaaggtggacgagctgaatgatctcgacctcaagcgtttctttgtcataaccgagcgcttcaatagccgctttcatgcgcgggatatagccgtgatggtctgctccccatacattgatcagcttttggaagccgcggtcaagcttgtctttgtgataagcgatgtcaggcagaagatacgtgtaggatccgtcttttttgatcagcacgcggtctttgtcatcgccgaacgccgtcgagcggaaccatgtcgctccgtcttcttcatagatatgccctttttcgcgaagggcttcgagcgcctgatcgatctttccgttttggtaaagcgatgtctcagagtaccagacatcaaatgggacacggaaattctccaggtcttcacgaagtttgcccaattcgtactttaagccgtattcgcggaaaaacgcgaggcgttcgctctcttcttcatgaacaaaacgatcgccgaattcgtcggcgagcttttggccgatttccttaatatcttcgccgtgatacccgtcttcaggcatcggcttatcttttccaagcgcctgaaagtaacgggcttcgacggataacgcgaggttgttgatttgattgccggcatcgttgatataatattcgcggctcacttcataccccgctttttcaagtacattgcagagggaatctccgacagcggctccgcgggcatgtccaaggtgcaggttgcccgtcgggtttgctgagacgaattccacctggacgcgttccccgcccccgatatttgtttcaccgtaggcctctcctgcttcaagcacagccggaatcagcttcgttaaatattgattgttcatgtagaaattgataaagccaggtcctgcgatatcaagtttgtcgatcgacgcttttcctttgtcaaaggatgcgacgatttcttcggcaatattccgcggcgcttttttggcgattctcgccagctgcatagccatattagtggaatagtcgccatgcgacttgtctttcggaacttccagtacgacttctggaatctcgctttcttcggcgaggccggctttcatgacagcttccttaatttcctgcttcagcacatctttcatttgttcgactatgttcatgactcgtgtcctcctctatacgaaatcgacatcttatgtaaatgcttttgttcatcgcttacaatcatatcgtactcaatgctgatctttccgtccggcggctgatgtgtgactgatacagctttagtatccacgccgagctcgagtctgccgaatggcattttataatgagtgacggtgcggctgcccggcctgaagcgctgtttcatttcgatggcgccggaacgcatgaccagaacttcgttttcacttgccttgacgatcgtcttcacctttccagcatcatgctcttcatgataagaaagatatattttatcttttttcatataataaaatccagttgtccggaactcgatcgtctccgtgtccgatccttcccggataacagatttcacatagatatgaacgggtgtctcctgatccattccgacacttcctttttcgatccgatttgacttgattagtataatcattcgggaaaaaaagttcaaccgcagctcctttatatcatcttaacagaacggacgggaagataaaccattttctaagaaaaaagccgtcctgaaaaaaggacagcctgttttatttcacccagccgagcagcatttcgcgaatcagcttgcttgccgtatttgcggtttgttccgaatggtcatagacaggagcgacttcgacaaggtctcctccaacgacattgacgtctgagcgggcgatttcgtgaatcgaagcgagcagctctttggatgtgatgcctccggcgtcaaccgtaccggttcccggcgcatgcgcgggatctaagacatcgatgtcgatcgtcacataaaccggacgccccgcgagtttcggcaggacggctttaagcggctcaagcacttcaaatttagaaatgtgcatgccgttttcttttgcccattcaaattcttctttcatgccggagcggatgccgaatgaatagacattgccgggtccgatcagttccgcggctttacggatcggcgtcgaatgcgagagcggctctccttcatagtcgacgcggagatctgtgtgcgcatccatatggatgatggcaagatcgggatattttttgtacatcgctttaatgaccggccatgaaacgagatgctctccccccataccgagcgggaattttcctttatctaaaatgctgtcgacatattcttcaatcatgtcgaggctcttctgcgggttcccgaaaggcagcgggatgtcgccggcgtcaaagaaatgaacctcttccagctccctgtccaaataagggctgtattcttcaagtccgatggacacctcgcggattctcgccggaccgaagcgggagccgggacggtagctgaccgtccaatccatcggcatgccgtaaaggatggcgtccgcctcttcccaatcggggcggcttgcgataaacaccttgccggaatatgcttcatcaaatctcatcttcaaaaacctccctgaaaaaaagcgcagaatgccatcctgcgccaaactgttttatttgattaaatcgctgacgaatttcggaaggacgaatgccgctttatgaatttcttttgtgtagtatttcgtctcaatatcaaagaagcggctgtcctccacttcaagaggatcgtattttttcgaaccgatcgtaaacgtccacaatccgcttggatatgtcggaatgttggccaaatacagctttgtaatcgggaagatctcttttacatcgcgctgaacgtttgtgatcagttcaggtgtaaaccaagggttgtccgtctgagcaacgaaaatgccgtcttcctttagcgcttttgctatgccggcgtaaaagccttttgtaaacaagttgacagcaggccctactggctcggttgaatccaccatgatgacatcgtactcattttcagattgggcaatgtgcatgaagccgtcatcgacttttacttcgacgcgcggatcgtcaagtttgcctgcaatggaaggcaagaatttcttggaatattcgatcaccttgccgtcaatatcgacaagcgtcgcttttttcacgctcggatgcttcaaaatttcacggataacgccgccgtctccgccgccgaccacaagcacatgctcaggattcggatgcgtaaacaggggcacgtgcgccaccatttcgtggtagacaaattcatctttttcagatgtcatgaccatgccgtccaaaaacagcatgttgccgaattcttcagtctcggccatttcgagcttttgaaaatctgtctgctctgtatgtaaagtcctgttgattttcattgtaataccgaaatttttcgtttgcttctctgtataccaaagtccgctcaaagcgtcatcttcctttcgtgataagctgtatttcaatctatttttctcgcctgcggcggcgattattctgcactgaagcatcggcttttgcctaaggaaaaagtatagaggaattgcaggtgattgtaaagacggatcgattcattttcaggagtcattccaagtccattatattcccaatcgccgatttttcttttataatggctaagctaagcacagatgtgcatactgtgcgcttttggaggtgttctcatttgcagagcaaacaactgctcaaattgtatataaccagccgccggaaaaggtttttattgatattttttctgatcggagcggccgttttgtttttcagccccgtttatatccgggaggctgccgttccgtctttgccggattggcttctcgaagtcagcggatctgtttatttgatgcatatggtcgctgtcctgtccgcagcctgtttgttctacggcacagcgaatggatgcggcgttcagcaggtgcaattgcaacaaacagaacggtgttgccgttgattttgctcggctgcaccgtttctgcttttgtgatgatctgcctgctgttttggagtgcggccatcggctggtttacattcggcggctacggtgcggagaatgttcatcctttttttgagctgtcgggttctcccctctggtttgttgtctcacgcctgttcattgactggtggtcgctttgctttctgatttttctcggcttggcgggagtgctgatcgcaaagaaagagcagcttgctctatggctgccgcttgcgtggtcctcgggtttaatgctccttttcaaattcaatatatcctttaaagggctgctcccgggggaaggcatgctgttgtccatccatgcagcaggagcttccccgattctggccgcatcagtcagcgaaggtgcagttttcgtattatggctgatttcatatgtggcgaccgccaaaaaataggattcctcatattgctgtcttaatctccgcagagggtctgccgttttttccttcccgcttgtttaaatcctcctctttttcctcataatgataagaacattttatttatccgggaggagatttgaacatggacataatgacggacaagcgggtccgtttaaccatcaagacgatacgcgcatttttgttcatgggagcattgatgctgatcttcctttcaatcgttgtcatgacggtggtcttggcggccaaatggcaaggcgctccttcgattcaggtgccgaggtctaccgtgctgtatgacggaagcggaaagcaaatgggggaaacgcattacgggcaaaagcggtactgggtttcgctgaagaacatcaatcccgcagtcatcgatgccacgcttgccgttgaagaccggaactttttccggcaccacggctttgactatatgaggatgggcggcgccctcattgccgatttaaaggcgatgtccaaagttcagggagccagcaccatcacccagcaatatgcgagaaacctctacctcggccacgataaaacatggaaaagaaagtggaatgaagctttttatacgataaggcttgaacaaaactacacaaagaaagatattttggaaggctatttaaatacgatttattacgggcatggagcatacggaatcgaagcggcttcccggctgtattttggcaagcgggccaaagatatcaatacggcggaggctgcaatgcttgccggcattccaaagggtccttcagtttattcgccctttgtcaatgaaaaaaaagcgaaagaacgccaggaaatgatcctgacaatgatggagaaacaaaacaagctgacggaaatgcaggcggcagcactgaaaaaaatgccgctccgctttgaaaaacagcaaacaaccgaaaaaaccgctccgtacttttatgacgaagctgttaaagaaatttcgcgattgctgcgtttgacgccggagcaagcggaaacaggcggctacaacgtattcaccacgctcaacccgcgtctccaaaaaattgccgaggatacgatcgaacacacgatagattcgtcatccgacattcaggcgggatttgcagcgatcaacccgtccgacggcagcgttctcgcgcttgtcggaggacgcgactacgaaaaaagcccttttaaccgcgtaacgcaggctatgcggcagcccggctccaccatgaagcctttcctttattattcggcggttcaaaacggctttacaccggccacccgaatgaggagcgcggaaacgacatttgagctcgggcaaggcagcgcttattccccgagcaactatcacggctattatgcagacggtccgatcacgcttctgcaggcactggctttgtccgataacatttacgccgtgaaaacccaccttttcctcggcatggacaaactgattgatgccgcaaagcaattcggcatcaacagcccgctgcaaaaagtgccgtcgcttgcgctcggaacatcccctgtgaagccgattgaaatggtgaacggatacgccatgtttgccaacggcgggaaaaaaatcgaaccttcctttattacgaaaattaccgatccgaacgggaaggttctttatgaaaaaccgaagcggagcaaacaaatccttgacccaaaagcggcttttatcacggcgaacatgatgagcgggatgttcgacaaatcactcaacggctatacatctgttaccggccggacgatcgcagatcagctgacgcgccgatacgccggaaaatcgggaacgaccagcaccgacagctggatgatcggcttttatcccggtcttgcttcaggcgtgtggacgggatatgacaaagagcggacaatcgatgccgtcgcagagaaaaactatgccaaacaaatttgggctgagtttatggaaaaagcgcttgaagacgcgcccgccgcagctttaatgccgcctgaaggcgtgaaagggatgtacatcgacccggctacaggttatgcggcggcgcccagctgcccgtccaaatatttcgcttattttatcaaaggtactgaacccgagcaggtttgctatggaaaggaaatctataaggagcaaaacgccgggcacgaaaagcccgccgctcccccccataagcggcaaaagtggtgggaaaaatggtttaaaaaaggagaataaactttttagggggatagacgaaccccccggacttcatggcagtccggggggtttttcctattgctggagcagtccctttttcagctcgtctgatgaacggtcccaaagcccttgatcatggtttttcagaaaatcggcaagaacgcgcttagaaccttcatccatatgctcgacgataatcttccgcttcatcgacttatccattaaattgacgtgctccggaagcgatttgtagccgcggcggatgcttctgtcgaccgtcatttcgcatgccgtcacacccgcataataagggccttcttccctgcggtcgatcgtaacccacacaagccagtaaggttttccgttcggcacctcttctttgttcggcaaaaatttgattcctttttcaaccgtgctgcgggcgtgcatggcgccgatatccacaaacgcttctttctcttcaacatcgacaatgacaggcgagatgttgtcaaggcttaatgcgcctgctccaaatcccccgtgtccgtctgtcggatcgcttttaataatgttgaatccgattgtttttttcttttttccttgttccatcaaaaatacctcctacatcagcggccggaaaacgctgttaaatatcgatatgatcaattcccgcccgtcattcaaaaacggccagaatacatattggccaagcggtgtaatgacgataatcagaaagacgatcgagccgtacgcctcatatttcgacagcttcgcccgcacttcgggggcgaccacatcctgtataacccgaaaaccgtcaagaggcgggaacggcattaaattaaacagaaataaaagcaggttgagattcacccaaatcgtaaaaaattgaagcaaaccgctgtaaaaaccggcaggcagcgtcccggacagcttcacggacaaaagcagcaatataaaaccgatgaaagcaaggatcagattgctgatcggtccggcgattgacacgagaaatccggccagcctcgggtttttaaaataaaagcggttaacgggcaccggctttgcccagccgaatcccaatataaagatcaaaatcgttccaaacggatcaagatgcttaagcgggttgagcgtcagcctgccctgccgtttggccgtctcatcgccgaatttgtaagccacatacgcatgggcgacctcatgcacagtgaatgcggcagcaagtgtcaaaacaacatacggaatcatttccagcggataaataagaaaacggtctaaaatgtggctttccctctttctcatatacaaagatttactatctccagtatactataagagaacctgatgctaaagtgagcagccattttttaaaaggaggaggagaacatatgccatacgtaactgttcaaatgctggaaggccgcacagatgaacaaaaaagaaatctcgttaaaaaagtgaccgaagccgtctccgaaacaacaggcgcacctgcagaaaaaatcgcggtcatcattgaggaaatgaaaaaggaaaactacggtgtcgccggcaaacgaatgagcgatatgtaaaagaaaacggcgttcgccgcttacgcgcgggacgccgtttttattatttataccaagctttgtttttagtgatctggctattgtgagctgaatcccaaacatcgaccgtgtatgcgtagtcgtagttcataatgcagcggattccgcttccttgcgcatcgtggttcaagccgaagttatgggaaaattcgtgggttgcagcttttgccgtgttggccgttccctggtcgaggtttacgctgaaggcgctgccgttcggcttgctgttgtatacgtatgcgatgccgccggcgtcaaaattactgttcgccgtaaatccgacgacgaatttatagctgcgcccgctgaaattgctctgaaggtttgatagaatttgagagctgttgctgcctgaagaggtccaaggcgccacagcttcgacgacaaaatcaacatcgtgatccctgttgaacatgacatccgcctgctcaataatttggacgattcttgtctgccaatcgctgtatttcgcccgatactgagcgtcagccacggcaaggacgctcactttctggcttcccgtgcctgcctgggttgaaaacgaccctttgcccgtattctttttaaacgttttcgttcccgtcacatttcctttctcatccagtattttcgtattgaccgttctttcaatttgaacttttcctttcaagtctttaaaatctttcgctttaggcaaagaatcaatataagttcctcttgcttcatgatcgtgctcgtgctcatgcccgcccgtcttggcggcaccggccgtcacaccgggaatgagactgacggaaagtaatagagataagaataaagaacgtttcttcactgcaaaacccctccttattttttgaacgaatgaaaaattctgctagttatcaaaaaattccttcaattcatccaaaaagaggaaatattgcatacgttcttttcactgcttctttcaatttccctacaaaaattccaaaacgcagacaaaaaaacaaaccaaaaaacctaccgtttttcggcaggcttatgaacaaagatttctgagcttttttatgtaagcgacggcttcatcgaattcttcgtccgtataccgctgtttgctttttacggtaaacactttttctctaatctcttcctgctccagcccctcaaaatacaaaatcgtcgacaccagttccaaaaaacgcgatgactggccgtttacgtcgtctaaataggctttaatatcccgcatatccagctcacactggctcaaaaactgctttcccgcttcagtgggtgaatagcggtattgataatagccgccctttttttctttgacttcatggagaaatccgagattgcaaagttcttcgacttgaagcgtcagctcctctgaataaggcccgtaaaaatgaaaatcatacttttcataaaaaggaagctccaatttctttgcgatataaatgattttctgcagctttttccgcccgacaatctcccccgaatccgagaagaccttcatcagctttgcatgttcttttaacaaatctccgccatctccttcatccttttctttctatttcagtccgagcaattctttcattcttttcgcatgacggccgtcaggcagcccttcgattaaatcgagcgggaaatacagcttatggtccgttctccgcttgcctgatatcgcatcgacaatatcggactgccgcgacagctccttaatctggccgttgtgcgtcagcaattgaatcgggaggcgttcctcttcttcccccggtctgtagaaatcataaggaagatctgaggacgaatccaccacaagataatattcgggatcaatccctgattctttaaacaagttggtcagttcaaagtaagtcgccatttcctcattcggattgaattccgcatactggaacagcctgcggttgataaaacggcggcataaatcagacaaaatttcgtcctcttctttttcccaggcctgaaaataataaagaatgattgattcatcaagacttaaataatcttccaatgtgacattgccttcaaaaatagaataaaaatgcactggcgcatgcgtgaaaacatagccttcctcatgaagctgctttgcacggtgaagaatcttcgtcaaaatcacttccgcacttcttgtcacaggatggaagtagacctgccagtacatctggtaccggctcataatatagtcctcaacagcatgcattccgctttgcttaatgacgatttggtcttcgcgcggccgcatgacgcggagaatccgctccatatcaaaatgaccgtagctgacgccggtgtaataggcgtccctctgaaggtagtccatgcggtcagcgtcaatctggcttgagatcaggctgacgacctgcttattttgataggttttcgcgatgacttcagcgacatcctttgcaaatgtcggacttaccttgtttaatactcggttaacttctgtatcgcctaaaatgatcgctctcgtaaagtcttcatgatcaagccggaagaccttttcaaacgaatgggaaaacgggccgtgccccaaatcgtgcagcaatgcggcgcaaaggcacagatcgcgctcgctgtcatcccattcctccctgcctttaaaaacgtcatcaaccattcttctgacaatttcatagacgccgagagaatggttgaaacggctgtgttcggctccgtgaaacgtcaaataggtcgtcccaagctgtttgattctgcgcagcctctgaaattcgcgggttccgatcaagtcccatatcagcttgtcccgtacgtggacatagcggtgaacaggatctttaaacactttttcttctgataattttccgtttggatacgccatttttgtccctctttttttcaaacgtgaggcaaactgatcgctgcccatccgtctctttttcttcggaaaactaaatgtatattgtaagtattgcccgatctgcttgttttctttaaggtctgcttctattatatcgagtctgtttttttgaaaacatccttgaatttacccggccatttgttccagcctgccaaaaagccgttaaacaagcaaaaacgcctgacccgttagggaggcggttattttttgagtttctttttcactttttcgatcagctcgtcttcatcaggagctgacagcggacgattattgacaaacgcaaacgatttttttcgtcccggcccgcagtaagactggcagccgatttccacttttgcatccggatcaatttctttcagacggggcaaaagcgtctttaaattggtggcctggcaatcgtcgcatactcgaaattcattagccatttcatacgcttcctttcgttttgttcatctgtctttatgaaaggcattcaactgtgccgaacttttataaaaaatgacaccatccttcattttacaaggattctttcattcctgcaaggatcgcgctaaaaaaatcagttcctattcttttagcaaacttgtataaatattttccaaaatggacaatctaataccaatactgacaatgggagttgagaagtgatgaaacaaagacaagacgcttggtctgaggaaaatgatttactgcttgctgaaacggtattgcggcatgtcagggaagggagcacacagctgaacgccttcgaggaagtcggagacagactgaacaggacatcagccgcctgcggttttagatggaacgcagttgtccgccaccaatacgaaaaagcattgcagctggctaaaaaacagaggaagcaaagaatgcgcgccctcggaaacggacagccggcgaaaaaacgcttattatacaagccgccggtcgaaacgaatgctgaacctcctgcagaaagcgttgttgagcagaagaaagcaaccgcagattcaagcgaacagcagccgatcgccagcgagcatctgccttatgttgatgagagctttaaagaagagttagctagtttatctcaccttctatcgccaaatcagccgcaggccggccatacagccgatacatcgaaagacatgacgatcgatgatgtgatccgcttcctgcaaaactatacaggaaacgaagaacaaactgccgctttaaaaatggaaaatgaacgtttaaaacaggaaaacgaagaactgacgaagaaagttgaaaagcttgaagcggaagtcaaaaagctggaaaaagaccagacaaccatccaggaagactacgaaacgctcgtaaaaattatgaaccgtgcaagaaaactagttttattcgaagaagacgaacacgctgcgcccgccttcaaaatggaccggaacggcaatttagaaaaaatggctgaatagcgctctcagaggatgcggcagagacgttcaggcagcaaggactgacaatgcatacaaacatttttcgatacgaggatacccctttctttaaaaaagggggtatttttacctttctgcggcttgcttttatatgacaaaaatttcataatagggatagcaattcataaggcggggtattcgatgaagtttgttttatatgcggttcagttcggcactgcggcccttttgtttttgttttctgcattggcaagctggtatcaaggcagcgagcttttaaaggtgccgtgggagtggaaatatacagccaagtttacaagttggctgtacggagaggactccattaaaaacgcacataatatttcacagcttgattttttcgtctatgcggccaagcatacgccggcaaccgttattttaatggccgtcagtttggcgtatatcatcgctttggcggcttatcttctcatcaaaacatatgtaaaacgaaaaagcgcttcgagcgcagcataaaaaaaccgctccggaagcggtgaggtgtggcaaaatcctaaaacgttcaaccgttttaggattttgccgtctttgaagcattttacagcccgctggtttttcaccgctttaagcatgcctgacaacgaatataaaggcggcggaggctcttcttctatccaaaaaccttttcattccgttcaatcatgcggacaaggtttttctcatacacttcctcttctgcgggcgtgagagggccttgataaatctccccgcccagctctttcagctgtgtcagaagcaagagcatcaagtcctgcaccgaaatgtcttcattgagaagctcagaaagcgaagccatcgtttccgggcgaatatcgggataaacggcttttgttttcccgcgcatgtctttcaaggcggtgtcgtaaaagcgtttgatcagctcagcgcgcccgcttccgctttgatcagcgcacaaataaatttgaacagccactccgcctctcaggcgcctctgggaaattcccgcaaatttccttcccccgatgctcaaatcaaagcttcctggacagtaggagcctttgatttcataggcttcgattgctgcgtcataggatgacagcattcgcttaacgagctcaaacatcgcttcatagcctctgtcgatatcaattccgtttttcttatcctgaaaaatcagggaaacgtttaaaaccccgctgtccaaaacgacggccagtccgccggaattgcggacgatggcttgatagcccgcttcttcaagcaatgaaatcccttcttgtaaataagggagccttgtatcctggattccgagcacaatcgtgtcatggtgcacccaggaacgcgcggtcgccggagataaacctttcccgacagaagcgcacagcgtatcatctatcgcaaatgattgttttgcatcaaaatatgggccgagactggattggtcaatgattctccatttcggctggatgagtagatcaatcggttgctttgccatatatagtgtaaaccctttcgttttgcatttcagccaacatccattataccatttacgaaaacatgtggtggaaattttcttatctccggcgcttccttcattcaagtgacgcttaaagacggttctccgaattcaagcggcagcccgacgtaattctcggcaagactttgagcggccgccgttgaagtcgtaacatggtcaagttcagccaattgaatctggtagtcaaaaggggtgtagccgtgatggcgatgcagcagggatgtcatataccaggaaaagcgttcagctttccagacgcggcggaggcaagactcagaatagccggccagccgttcgattcttccggtttcgtaatagtcttcgagcgcccatgcaagccgctggacatccgccatcgcaaggttcaggcctttcgcacctgtcgggggtacaatatgcgcggcatcccccgctaaatagagtctgccgtattgcattggatcgcatataaagcttctcatcgagacaatgtttttttgaatgatcgggccttcagtcagcttccatccgtcatcggccgacagccttaggtgaagcttctcccatatcctttcgtccggccagttcccgactgaatctgcaggactgacttgcaggtaaagccgctggatttccggtgtccttgtgctgacgagggcaaacccgtcttcatgatgggcatatacaagttcaggcgaggacggaggggcttcagccaatatgccgagccatccgtaagggtacaccttttcgtactctttgcggatctccttcggaatgctttgtctgctcggcccgtgaaagccgtcgcaccctgcgatgaaatcgcagttcagttcttctgtatcgccgttttcattctgataagtgatgacaggcgcttctgtatcaatatttgaaaggcggacgtcagacacattgaaaacgatgcgcccttccgattgcaggcgggcggcgattaaatctttgatcacttcatgctggggatagatggcaatgtatttcccccccgtcagcttgtgcatatcaattctgtgccgcttgccgccaaagcgaatctcaattccttgatgaaacatagctgttttcatcatccgttcaccggcacctgtttcattcagcaaatctaccgtcatctgttctagaacgcctgcacggacggtctcttcaatctcctttcgcgagcgggattcgatcacaaccgcttcgattcccctgcggtggagcaggttagcgagcataagcccggcaggtcccgctccgataattcccacttgtgtccgcaaaatggtttcctccctttatccatgttttgatgtggcttctaatgtatacccggcgctttccgacttagagacaaaatcaaatgaagcgtgtttctcttggacgagcatgatgccgagtgcagcaaaaacactcgggatcgcgaacaccatgaaagcctgcttcggctccatgccggaagcaaggatcaatgcaaacagcgaaggcgcaatgatcgctccgagtctgccgaccccgagcgcccagccgatgccggtcgctctgatttctttcggataatactcagaaatataaggattggcgatattttgcgctccgacggtgcatgccccgcctaaggcaatcagcaagtacagaagaacggggttcatcgtcattccaaatgctgcaaaacaaaaggctccgatgacatacatagccgcaagcacatttttatggccggctttatctgccaaatatccgccgaataccgctcctgcggcttgtccgcagcaaagcgccaagttgaatgacaagcttgacgacagcccgtagcctgacgcctgcatcattttcggaagccatgtatttaagccgtaaaccatgagaaggcagctgaaaacggaaagccagaatgcgaatgtgctggctgcacgtttttgtccaaacagtttttttaccggaaagcctttcttttctttcgcaatcaccgagatttgataattgtcgtcttccctgtagcgtcccgccggatgcacctgattgaaaatctcagccagcgctttcgtctttttcttcaaaacgtaaaatgacagagattcgggaaacctgctgaaaaagaacgggagcacgaagagcggcacggctccgatcagatagagcactctccagcttgtcacgggcacggcgaacatgccgacgagggaagccagcacaccgcctgcagaatagccgcaatacatagcggctacaatcaccgctctgttttttttcggcgaatactctgtcatcagcgaaatggcattcggcatcaacccgcccattccaagcgcagcgagaaaccgcatgatcgtaaacaaaagcggagaatcgatcagaccggctgctgcagtaaacaggctgaacagaaagatacagaagcccaacacctttttgcggccgtattgatctgcgatcggcgaaaaaataagcgcgccgagcatcatgccgatcaatgtatagctcccgatcgctccggcttggatggcggtcaggctccattcctccatcagccatggcaggctgacgccgtacattgcaatatcataaccgtcaaaggcaatggcgaaaaaacaccacaggaaaacagtcaggtgcactttgttaaatttgctggccgccatgacttccgctggatgaactgaacgatttttcatgttcccctccacgattcttatcgtattatgaaagcagcttaacgcacggtatctttttcattgaaagcgtgcgtgcgagctttttgtcccgccggctcgaatgccatgacgacattggagctcccggaagactgaccgtatccgtaaaacgtgcttttacatccgtcctccagcacgcccaatagcattgcaatgtggcggccgccggcttcaagcccggcgtttttagcatattgaggcagcatctgctgagctgataaaagatcgttgtctgttaagtaggtcaaaaattgtgcatcgagggcctgttcggccaatgtcggcatacattccggccccctcaccaaatgatggcttagcgccccgctgctgatgaacacggttttctttctgctttctttcagcactcttccggcaagccggccccacaaatgcgtttcttccaggttcgcggccaatgtaaccgataaatcgataaccggaatatctccctttggaacgaggtagcgcagcggaacgaccgtcccgtaatcccagcagtaagctggatcattgacaggaatgacggaaagccccccttctctgccggcttcagccaattgcagcgccaattcagtgtccccggggtaagaatacggaacatcggaaattaaattcggacactccaaagccgttaaaacgccttgatggtcgggagctgcatcgatcagatggtcaaagcttgacgtccagtgacaggaaatcaggacaacggcatcgggctcaattctttcaataatcctggagagcctcttcatgcccttgaccagctctctttggaagtcaggggttttatcttcaaaacacatcctcggtgtatgcggaacaagcgccgccaattcgattgacatgtagattcctcccatcgccttctttaaggtcttaattttgagaccggtgtgccgcctatgccccagtggcttttagaaacttcggtgacaagaacgcggacgttttccttcggagagtctagggtggcgctcaacgtttccgtcacttttcgaatgacttcctcgaccttttcaggcggccggccttctaatagttgaatatgaacaatcggcatatcataatcacctcaggttatggcttgaccgaaaatgatacatctcccagcccttctacttgtgctgaaacgcggtcgcccggctgcagcatgacagctcccgttacaccgcccgttaaaatgatgctgccagccgcaagcttttgttttttccgggagagcatgttggcgagcatggccgccgaatttgcgggatgcccgacaaccgctgctccagtgccccgctctttgacctcgccgtttatcattaaagagactcttgcttcatccagcttgaaatcgtccggcttcttcactttttcacctaacaccactcttgaagatgacgcattgtccgcgatgacgtcaggcaaagtgaatgagaaattttcatagcggctgtcaatcacttctagaacgggaatcaattcagcaacggcttcaaggacctgctcctttgtaacacccggtccttcaatatcctcccccagcacaaaagcaatctctgcttcaaccttcgggtgaatcagctcgttcatccggatgcttccgccgtttggcacgatcatatcttcaaaaatataaccgtagatcggctcctcgacgttcatctgcttcattttcgcccggctggtcagtcccattttcggaccgatgatgctattgccatcccataatttaagctgaatcagctcttcttggatcgcatacgcctcttcaacggtcagctccgggtagtcctttgtgattctttcaacttcacgcttctctgtttcggcaagatacaagagtcgcgccgtatcttttaatgctgcggtattcatccgcttccccccttttacagcttgatgcaaatattggttaattcgctgaagaattcgaggctgtgaatgcctccttctcgtccgagtccgctctgtttcatgccgccaaacggcgtccgaagatcgcggagaaaccagctgttgacccacaccatgcccgattcgatttgcccggctacgcggtgcgcccggcggaggtcgttcgtccataaggtcgcgcttaacccgtaatgtgtgtcgttagcctgtgcaatcacttcctcctcatcgtcgaacggaatcaccgttacgaccggaccgaagatttcttctttgatgagcctggaattgcgtgaaagtccggtgataatcgtcggttcaagaaagcagccggattcctgtccttcagggcgttttcctccggttaaaatattgccgccttcccgtttggccaattcgatgtagttcatcacacgctctgtgtgttcagaagaaatcaaggcgccgatattcgtgtccggatcaaaaggatcgccgactttgagctttttcgttttctcaacgaacttgttcagaaattcgtcatacgcttccctctcgacatagatgcgggagccgctcatacatacttccccctggttgacgaaactcgatttcaatgaggtgctgacggcttcatccatgtcggcatcggcaaaaataatgttcgggttcttccctcccaattcaaaggaaagtttctttaatgttttcgaagcagcttccataatgactttgccggttgtcgtttctccggtgaaagatatcgcatcgacatcgggatgctcagaaagcgcagcaccggcggaatctggtccaaatccgtggacgatattaacgactccgtcaggcatccctgcatcatggcagatttccccgagaagggtggctgtcatcggcgtcagttcagccggtttgataacggctgtatttcccgccgccaggcaaggcgccaatttccacgtcagcaaaagaagcggcaagttccacggattgatcagcccgacgacgccgaccggacggcgaatcgcataattgattgcaagatcgtcagtttgataagcttccgttccggctcctctcataaaatccgcaaagaaatgaaagttgaaagcggcacgtggaatatccaaagtgcttgagagcgaaagcggttttcccgtatccaatgtctcaagcctcgccagttcgtctttacgctcaagtatgatgtcgccgacctttctgatgatccgaatcctttcgtcagcggtcatgtttttccagcgtccgtttaatgcacgcctggctgccgcgactgcaagatcgacctcttttttgcctccttccgcaacgcttccgataatttcctgtgtagccggattgatgttgtcaaacgtgctgcctttctctgaaggaaagtacctgccgtttatgtagtgctgacagtcaaaaggttttacgagtttttccgatggagtttgaacattcatattctgcaaacatcctccttttcaaatcctttccattaaattaaaggattttaactgacaagaaaacagcaatgttcctctatgcggaacaaatcagacattttttccgaaaatttgatattttccgcttttttattttttatatcgtgttatattatggaataaaaggaaacaaaaacaagggagagagttgaggaacctatgactgttgagacgaaggaccaccagctgctcggttcagtaaaaaatgcgcttcggctgcttcaatcgtttaccttagacacaccggaaaagaaactaaccgaactcgcctcgtcgcttggcctcggaaaaagcacggtctcgcgccttttgtctacattggaaagcgaagggtttgtcatgaaggacccggaatccagaagatacaagctcggcttatcggtcctgcagttaaacaccattgtcaactccactcttgaaatcaaccgcgaatccctgccggtcctcaaacggctgaccgatgagaccggcgaaacgtcgcatatcgcgatgcgccgcggtctcagcgtcgtttatctcaatcggacggaatgcccccgcccggtcgaacttctctcatatatcgggcggcaaaacccgatgcactgcacaagctcaggtaaggtgcttctcgcctttgatgaagagggcatattggacgagtatgtgaaggaaggcttgaaaagctgtacgaaagaaaccattacagacggggacaaattgagggatgtgctgaaaaccgttaaagaaaacggatttgacgtcagttgcggggaattcatagatggtgtcacatcaatctcagctcccgtcagaaaccacgcaggtcgagtgttgtacgccgtcagtgtcgtaggccctgcaaaacgcatcaaggcccggcaggcgaaaatcatttaccaagtgaaacaagcggcccgggatatttccgaaaggatcgggtactggaaacgaatataaaaattgggggaatcagctttgtatgatcttcacacgcactttataccgcgcgatgtgctgctttggctggaagacaatgaaaagagagtccacgctgtccgcgaaaaaaaggctggatgccaagcggagtttttgacggtcaatcacaaatggggctttgaattaaaagagcttttctaccaggaggctttatatttggaagcccagcaggaggccggcgtcacacactcattggtatcgccggttccccagcttttcctttacgatctcgccgaagaaatcacggacgaattatcttttgtatacaacaaagcgcttgccgaatgggttaaaaaatacgacggccgcctctcgggactcggcacagtcccgctgaacagcccttcaaaggcgagcgagcgcctgaatgaagcgatgaacaacgggcttaaaggagcgattatcggacccggcgcttcgcaactacttctctcggacgaagcatttacaccgttttgggaaacggctgatagaagaaaagcgattatctttatacatccgctcctttctgaagatccgcggctccgccgcaggatgctgccaaacttgatcggcgttccgtgggaaacgacgatttgtgccgcagaccttttgttaagcgggtttacagaccggtttcgcaatgtgaaaattcttttggcccacggaggcggctttttgccttatcagatcggaagactgaacaaagggtatgacaaatgggccggcgtttcttcatcgctttcggctccgccgcgcgaatatttgcggaagttttggtttgatggtgtgctatgggagcaagaaagcgcggcatatttgaagaagcttgtcggagaagaccgccttgttccgggttccgattttcctttcgacctttgtcagtggccgcctctcgatcccggccggaaaggagcggagtctctgctgaatgtagcgattgaagcataaaaaaaggcgaacctcttcaggttcacctttttcaggaagcctattacagagcttgagccgccgtaatcagcgcaagattataaacgtcctcagcgttgcaccctctggacaggtcgtttacaggcatgttcagcccttgcagaatcggaccgaccgcttcaaagttgccgaggcgctgagcgattttatagccgatattccccgcttcaaggcttgggaaaacaaatacgtttgcatctcctttaatgacggagtccggcgcttttttctcagcgacagacggaacgaatgccgcgtcaaattggaattcgccgtcaagtgtaagctcaggcgctttttcttttgcgattgcaaccgcgttggctactttttcagtttcgtctgattttgccgaaccttttgttgaaaagctgagcatggcgacacgaggttcgatgtcgaacattttcgctgtgttcgcactttcgattgcgatttccgcaaggtcctggctgtcaggcgcaatgttgatcgcacagtctgcgaatacgtactgctcatcgccgcgcgccatgataaagacgcctgatgttttcttcacgccttcttttgttttaataatttgcagcgccgggcgaaccgtatccgctgttgaatgagccgcaccgctgacaaggccgtcggcaagccctttataaacaagcatcgttccaaagtagttttcgtctaaaaggatttggcgggcctgctcttccgtcgctttgcctttgcggcgttcaacgaaagcctgaacaaggtcttccatcccttcatatgtatgaggatcgtatatgtcaacgccatccagcgttaaattcaacccgtttgctttatctttgatttcctgctcgtttcctacaaggatcggctttaacacgttgtttccggccaatttgttgacagctgtaagaatacgctcgtccaaaccttccggaaatacgattttaactccttttcctgctacttttccctgcactgttgtaaatagatctgccactatataccctccttgaaagtgtcacaaatacttcatttctctattaagcatactcttttgtgatataaattcaatccttctgtattttattataacgtttacactttttaaacgctttttttaattaatttaatttcagaaaggctttaaacacttctattagtatataacagcctttcccagttatacgacagatggtcaccttttgttcaaaacttctaaacggataaaacgcggcaaactatgatatgatgaagacaagtacatacaaattgggagtgattgcaaaatgagcgaacagcaaaaaacgaatgaagccgcacaaacgcttgacggctggtatgcccttcacgatttccggacaatggactggtccgcatggaaaatgctttcaagcgatgagcgccagatcattatcagcgaatttaccggccttcttgaaaaatggggagctgcccaaaaagaaggaaacggaagccatacgctttacagcatcgtcggccagaaagcggacttcatgctgatgattttgcgccctacgatggaggaattaaatcaaatcgaactcgagttcaataaatccaaactcgctgaatacacgatacctgcttattcatacgtatccgttgtcgagctgagcaactatatgggaagcggagacggagacccttacgaaaatccgcaagtgcgggcgcgcctgtaccctgagctcccggatgccaaatatgtctgcttctatccgatggataaaagaagatcgggcgatgacaactggtacatgctgtctatggaagagagaagaaacttgatgcgcagccacggaatgatcggacgcggctatgcgggaaaagtaaaacagattattaccggctcaatcggatttgacgattatgagtggggtgtcacgctcttttcagatgatgtgcttcagttcaaaaagctcgtctatgaaatgcgctttgatgaagtaagcgcccgctacggtgaattcggttcgttctttgtcggcaaccgccttgcaaaagaacagctgcctgcatttttgcatgtgtaatgataaaaaagctccaaaggccgaggtctttggagcttttttgcctatttacttgcagttgcacggctgtgtaggcggagtcgcccgtttttgcacttcgattgaagattcggcatagaaagtcgatccgagccccagtactctgttctccgcccggaatgtatactttcctgcggcaggcagcgttttgttggccagcaccagcttaaactccgcaatgcccagcagatcaattgtaagcggcagccttaccgtttttccgttgttcaaaatttgccctgttgtcagcgctcttccattcaccgtatctttcgttgtggcggaaaatcccgacggcaaagtaaattcaaccgttcccagcgccaagattgagttaggacgatatgttaactcaatatccgagaacgaccactcctgtttgctggcgcctgttatcaccgaatacaaggaagcgctcgcagccgggcggtagacagattcagtttttgttgtttgggcgctggcctggaacgaaggcaggaaaatcgaagccatcatcacgagactaaccgccaagattgacaatttagaacgatacattcttttcaacacagcaattcccccaagtcatcatttttttcatattcgtcatgacgaaagcgtgcaagaaagatgtaaaatcaagcaacgccttctttccaaagcgccggcactttggtgatttctattaaaaactaccattttttctgcttgtagtaaatgttttccatgtcatatttttaaaataaatgcaaaataatagaatttaaccaggcgttgttcctcttgattttctccgctgtgctttagtaaaggacaaaaggcctgcccgcttcccttctcttcattctcctgattttttgttgacaaacgatggatctggctgtacattattgacattattgaagcatcacgaaccgagtttatgattgacataaccttgctttttctccattcatgttttgaatggatgaagaaaggaacgaaaaatgcctaaattggtttcttcaaatcttgtaaaaggtaagatcatcaatattagtccgccgcagacgctggctcttagtttcttgattatcattgcgatcggggcttgtttattgaagctgcctggcgcctccactacttatatctcatgggtggatgctttatttacggccacctcggcaactacggtaactggccttgttgttgtagatacaggggcagattttacagttttcggacaaaccgttattatgtgcctgattcaaatcggcgggctcggcttaatgacgtttgccgtcctcgtcgtcatgatgatcggcaaaaaaatcggcttgcagcagcggattcttgttcaagaagcatttaaccagacttctttaggcgggcttgtccgcttggtcaagcacctgtttattttcacgattgtcatagaatttgtggcgtttctgatcctttcgatcagatgggttcctgaatatggtttgcaaaaaggcttgtttcatagtttgtttaacacgatttcagcctttaacaatgcgggattttccctgtggcctgacaacttgtctcaatatgtcggcgatccgattgtcaaccttgtcatcacaggccttttcattacagggggaatcggctttaccgttctgctggatttatggacaaagcgaaacttccggaaattatcgctgcattccaagctcatgatcgttggaacattgatcatcaatacgacagccgcgttgctgattttcattttagaatactcgaatccgggtacgctcggcggactgcctttggccgacaaaatgtggggcgcttacttccaaggcgtgacaccgagaactgccggattcaatacgcttgatatcgcccagatgacaacgccgtccctcctgttaatcatcgttttgatgtttatcggagccggaagtgcgtcaacgggaagcggaattaaactgacaacgtttatcgtgatgatcttggcgacgatcacctttttaagggggaaaagcgagacggttgtgttcaaaagggcgattaagatgaaaaccattttaagagctttagccatcattgtgatcagttttttattcgtgcttttcgcattatttatattgacgatcacagagaatgccccatttttgaaaatcgtctttgaagtattttccgctttcggaacagtcggcctgtcgatgggactgacacctgatttaacggccgcaggcaaagcggttatcatgatgatgatgtttatcggccgcgtcgggcctctgactatggcgtttacgctggccaagccgaagaaggcgccgatccgccatcctgaagatgaagtgattacaggctaatatgcagaaagaccgctctattcacgagcggtctttttgtttttctctttccaacatgatgtgtcgtcatattccctcccgcccgttcatactgtaaaagggatgggaaatattgatctatcatcttgagtcagcccacagcttttcagccggatcgtcttcatagcagcactttatcattcctcatgtatagatggtaggcatgactttgacacaatgaaatgaggaggaacgagatgaaatttaaaaaaaatcagtttcagccgcttcaggagcttgagatgccggatttccggcagcaaatgggccccaatccttatccgcagatggggcagatggggcaaatgtaccagcagcagggacagcagcctttcacccaaatgggagggcagcaatcgtatcagcagcccggtccccagctgacccagccgcagccggcaggcgtccaggtccctccaatgccttcaggacagcagccttcaccgagcatcccaggcatgctgccgcttgagcaatcctacattgaaaacattttgcggctcaatcgcggaaaagtggcaaccgtatatatgacattcgaaaacaatccggaatggaatgcgaaagtctttcggggagaaattgaagcagccggccgcgaccacatcattttaagcgacagaaaaacgggcacacgctatttgctgctcatggtgtatcttgactatattacgtttgatgagccgatcacttatgattatccgtattcaatggcctcatatacaccaagataaaggttcggtttaactaagccgaaccctttttttatagatgttaagcgaagtttctcacatcattattgcgtttgaatttgtaaatgacgatgaggaaaaagacagcagcgaaagcaaacagaatcatgatattcaaatacagaccttgaagctgctgtccctcctgcaattttgccagcgtatccaacacccaccgctgcggaagaaagtccgcgattcgctgtgcgaaagacggcatgatttcaaccggccaaaaacatcccgacagcatgatcgtcggcataaaaatcaaatttcgcaataccccggatgacctggagctgtttgcaaagacgactgtgatcaatgccaggccgaccgcgctcagcgcaaagatcagcagcaccgctgccatctcccaaaatgagatgccggtttccatccggaaaacatatttcaccataatcaatgttaaaaaggtttggcatgtgatgacagacatactgacggccacattggacatgacgtactgccttgccgttatcggtgtggtcaaaagcctgaaatacgttctgttctctttttcctttactaacagttcggtcaagcttcccgctgaaaaaagcatcgccatcagaagaaaaccgaccgtccgctccgtcatgtttctatttttcgccgtgtcttcaatcgtagatgttttgacactcgtttcagaattccggtaatttttatacatttcctcaaagcgcttttcattcccctgcgccgatttgccgattgcggcgatattatcaatataatgatagacatacgatttcacgaatccggtgatttcagcgcctttgacagatgcgattgcgatgtgagccggttcgccgctctgcacgctttgagaaaagccttgttcaaacgtaatgacgcaatcaagctcccctgccgcaacttgacttttcccttctgcttcactgaccgcactgatgttgacattctcgatccccttcaaaaaatccttagtatcttcggcgattcgtccgccgtcatgattgatgattccgacgcgcaaatccgtcttttccatgcttccctctgtcaaaagcgatacgaatatgcctagcaagggcagacatacaaacagaaagatattgatcttctttttaaaagtgacattcagtgtgtttttgacaagccatagcatttctttcatcctacagcccctcccttctctgcaatgagacaacggcaatcagcagaaataacagggataagccgatgttcagcaagatggcaggcagccctgccgctaaatcgtccgcaaatatgatgttcataatagcttcgttcgtccaggcgagcggagacaggtctgtgatcaaagctaaaacaccttccgcatcgtcgacaggaaaataagcgcccccgaaaaatgcaactagcggaatcaacacgttaatgatcgccactgccgcttcccccgttctcgtcaaataactgacgccgaggccgaggcatacggcaaacaatacgatgctgaacagcacggccgctacaagcccaagatgctctccccagtacgctttaaatacgtatttgctgactgcgacgacggcaaaaatacacaatccgtttgtcacaagattgccgatcagcttacccgcaaagatctcgcctttatgaaccggtgccgcgatcagccggtcggctgtttttctaagccgctccccccttattaaatagctggcgcttaatgcactgtaaagcgcgatcagagtggtcatggcaaccgcataataatccatggagctgggctttctgtctgagctgagcgacgtctccttgatataattgtcgcccggtgcgtccccgagcacggcgcccgcttgctcaggagcagctttgatgatctccgctgcggcattgtaccggtttgcaaacgcggtcagcattccttgaataatgctgtttttcatactgtttttatccatttggtaaagcttgatgccgctgttttcgatctcaagataagcatcgtagttcccctgtttgatttcttgtttttcatccatatcggacaacacttttttaaaatgaacgccggatgttttcgcttcctttacgaatgttttaaagccttgcgaaaacgctccgtcagaattgtctttatacaaaacacgaacctcgccgaccgctgcttgttgatcgaaagcattcgtcagcgcagtgcctaaaatcataatcagtacaatcggaaatgccagcataaaaaggaacgtccgtttgtcccgaaaagcagatacaatttcttttttcgcaatgatgagtgtattcaaaccttggacctcctttctaatcgcgcaactgtcttccggtcaaggtcaggaacacggtttccaaattaggcgctttttcttccaatgaacgaatctcggccccgtttttcatcagcttttcaataatctggtttaaattattgacgcctgcatccgagttgattttgatcgtattgtcttcaagaacggccgcttccacgccgctgatcgttttcagttcgccgatatcgatattttccgcagatttaagaacgacttgaatatcttttgtgttggtaatgatcgatttcagctgctccttcgttccctcggcgataatttttccgtgatcaacgatggcgatccgagtacagatctcttcaacttcctccatataatggctcgtgtaaataatcgtgcatcccatcgcatttaactttttgacggattccaaaatataatttctcgaatgcggatcaattccaaccgtcggttcgtccatgatgatcagctttggcctgtgggcgatcgcgcaggcgatattgagccttcttttcatcccgcctgaaaaatttttcgggaagcttttatgcttatcacttaaaccgacgaactgcaatgcttcttcaacccgattgtgtaaatgggccccgcgcagaccataaagcccggcaaaaaatttcacatttgcatatgccgttaaatcttcgtaaatggccagatcctgcgggacaatgccgatgttcatcttggcgaacttgcggtgtttcgcaatgttttttccgagaatcgtgatctcgccttcattgcttctcaacaaactcgaaatcatgtgaatggtcgtactctttcccgccccgtttgcgccgagcaatccaaatatttcgccctcttcgatcgagagtgatatattgtcgacggcaacgaagtcgccgaattttttcgtcagatgatggatttccaatacattcatgttctcacctcattttgatttcattataaaaaaaagatgaatggtgcggcagtgcagcatttcatctttttcacatgagaaaattcatattcaattcatgaaatcattcatgcttgggcagcagggtggtgacagagaagccgtttgaaccgtcaacgatcacctttccgttaacagaagcggcccgttcctccatcccgatgatccccatccctttcttgattttctgccgcccttttccgttgtctttcacttcggctttaatgagcgtattcagcacatgaatacagatggatacatgtgtcgcttcagcatatttcaccgagtttgtcagcgcttcggtgatgttttcaaaaataatcttccattgaatctgagaaataacatccaaatcgcctttatgcaaaaatgaaatattcatatggtactgcgccgaacattcatcgataaacagcctcaatctgtggatgcccatctgttctgagggcggcttgacgctttttaacgtcaatctaatattttcgatcccgtccttggagatgttaatcgcattttgcaggagctctgaagctttttccttgtctatgtcaaggacgcgcttcgccgcttcgagctgaatcagcgctcctgtcatggaatgaccgattttatcgtgtatttcctgggaaagccggttgcgctcctcaagcttataagtatattcggattgtctgataaactctttgttttcacgcagcatgtttgtcagcttctgcaggtctcttctcgtttgatcaatatgatgttcaagcttttcaatccgcgctgcatcatggcttgccgcccagtacagcaaaaattgaaaagcggccgtcaacgcgtagaccgctgagatgctttcattgataaacaagaccggaacgattgaagcggcaagtaccgcccacttcggcagcccaaaatcggctgctccttcacacagggtaaaaggaaggaataaaataaatagggggtgcacttctgcataagaaacgattgaaatgatgacagaaatgataataaaaagcttttttgtttttcctttaggtaaaatcgcaatcccgaggttgatacagacgtaaacaagaaggctgaacacaagccacggcagattgtcactttccgaaaaaacgcattgatagatgataaatcccaacaaaatcagtttgccggtcataatccgcaattccatggtgatcccccaggttaaaagttaactttaccggttaaataataaatcgcaatttgcgtccgatgttcaagccctgttttccccaaaatcgaggaaatataattggcaatcgtaccttcagagataaacagctccttcgaaatttctttattggacagccctctggcgatcagcgccataatcccgagctcgcgttcggtaaacaggctttcgtctatcttaggttccgcttctttatgctccgccaaattggacttaatcttgtcgaggatgatatcctgcatcacaatatggccgttgaacacacttttaatcgcgtctctgattcgctcgggttcggcatttttcagcaaatagccttttgcgccgttccgtatcgcagcgacgatgtattcgtcgtcatcaaacgttgttaagataaaaggcttggcgcccgtttctgaaatgagccgcgcagcttccactccatccatgttgggcatgcggacatcaaggagtgcaatatccacagcttgggcgcggcaaaattcgaccgcctgcaagccatcctccaccgtcgccagcacttcaaattcatcataagtgctcaatatgattttcatgccctctcttatgaatgaattgtcatccgcaatgatcactttaattttcatcgtttgaacggagaccggtcctccgccgtgcacatcccttctgtcaaaatgcaaaagccgggtctttcgccctgttcataacattaaattaccatgaatcagcccctgttaaaataaaaaaagccaatccttttcagagattggcttttttagtaaaactacaaatatttgaccgctgagacaacgaccatgatccatgcggcaataaacgccacgccgcccagcggagtaatcgcaccgaggacgctgatttgcgtaaggctgaggacatataaacttccagaaaataaaacgattccggcaaacatcagccaccctgccgcagaaacgcttcccgcacctgccagttttgacgcgatgagcgcgacggcaattaaaccgagcgcatgatacatatgatactggacgccggtctgccagatttgcaaatatttctcgggaattttcccttcaagaccatgggctccgaacgctcctaaagcaaccgcaagcatagcattgacagcacctaaaatcaaaaataatttcacgatcaaatcgcccgcctttcctttatcatcatagcgtacatgtcatgaatttcaacttatgcaaatctcatgacacgatattgtcatatttctttttcctaagctgtatttgttccgcagcaatcgctacgattgttccaaggacaagcccattgcttaaaatggaaacaaaaacaggatgcatcccttccaaagcactctcaggtacaaacataacccccacaccggcaaggagcgcaatcccggtaacaaagcggatgcggccggcctcgtccttttcataagaatcgaattcggcaaatgccaggccgaccatcgttgaaaacacgacgaagttcaccgcaaaaccgaccggagacggcaggctggcaaaagtattcatgaccagcgggaagaagctgatgacgattacgatcagactcccgagcaaaaacggttttttggaagacatcctcgtcgtttgaataaaccctgcagctccggatatcggcacggtccctacagctccgagcagtccgctcagcaaatggctgacagaggcgataaacccggccggacgggcccgcttcctctcttccagcttctcaaactgtttgactgctccttcaaccacccgtatgcttgcgagcatattgacgattaacaaaactgtaatgaacaacgaagtaacaaccagcccgctgtcaaacatcggcatgccgaaaggaaaaatatccggaaggtggaacagctggttcgcacgctcgggcgccttcgccacgccgaatacggcaaataagatccagccgccgaaaagcgcaattaaaattgaatattgcttgagaatcggaacgtttgaccggctcatcagaaacgtagccagcataatcacaaccgccagcaaaaacacgggtatatcgacctcgtttttccggtagccgatccccatgacacctttaacgatcggatcgctaagctggatgaccagcagcagtaaataaatgcctgtcacaacaggagtaaacatcacagccagcttatcaatgactttaaataaactaaaaataaagaagaaaaccgcgcttagcagcatcgctccctgcagcccctggagcgtttcgatgtgagtcgcgaatacggtccctgtaagaccggcataaatcgtgtagacgccccaccagaggccagccggactctcattaatcggcaggcggtgtcccaataaacattggataaaagccgttgtgccgagcacgaaaaaagtgctttgaaccaaccccgcggtctctccctggttcagcccgaatgactgcccgattgcaatgggcaccacgattgcggacgcaataataaatgccgtccattgtaaagccccaaaaagcagtttcaagttgatcaacctctcttttttaaaacagacggacggcgcctagaaatcaaaaatagaatctccgttgccgtcatcttcatgcttttgtttctcttgttttttgtattgttcagcaccggcgctccccatcattttttcgagcatcagctgatcgctcgatggtttattggccgtttgaacataaggcgaagactggacggacggcccctgctgcggttccacaatgacgtcgcaaagggagcggatcaccgcgatgtgcattttcaattcgttttcctggtggcattcctttgcttttttcaattcgtcctccatcttttgcagcaaacttgatatatgtatgttcatcaaatcgatcctccaaaccgttttcagtttccatttcattttaccaaattaacttctctcatgccgaatgcacttttcaaatattccttgcgaaaaattgcctctgctgctatgaagcattgtcttttacatttcaaaaaagaatattccccggcaaaacgcgggtgaaaaaagccaattttcttccggacagaagttgacagctgaaaaggctgtcacccataatgaaaaaaacttcactcgaatttctaaaagcgaaaggaaacagggaatggcagaacgaacaacctccatcgaaacgaccgttaccgagcaaaagcaatattttttaagcggggcaacactagctgttgaaaatcgtctggaacagctcaacattctaaaagatgctgtaaaaaagaatgaacggaacatacttgaggcccttcagaaagatcttaataaatcagagcacgaagcctatatgacggaaataggcattgtactggaagaaatccgcttcatcagcagacgattaaaaaaatgggccaaaccgaaaaaggccaaaacggccgtttcgcacatcggttcaaaaagcatcgtcattcctgagccttacggcacggttctgatcatcgcgccatggaactatccgtttcagcttgccgtctcgcccctgatcggcgcacttgctgcggggaataccgccgtcatcaaaccgtctgagcttgctcccgccgtatcaaccgttatatccgagatgatcaaagatatctttccgcccgaatatgtgtccgttattgaagggggagtgaagacaaaccaagagctcttgcggcaaaaatttgactatatcttttttacgggcagtgttcccgtaggcaaagttgtcatggaagccgcggcaaaacagcttattccagtcaccctcgagcttggcggaaaaagcccctgcatcgtgcacaaggatgctgatctcaagcttgcggctcaaaggattgttttcggaaagctgacaaacgcaggacagacttgcattgcgcctgactatctgctcgtacacaaagatgtaaaaaatgagctgatgcgcgctctgaaacaatcgatccaaacattttacggagaaaagccggaaagccatctggcttacggaaaaatcataagtaaacgtcatttcgaacggttaatccgctttttacaaaacgagaatatcgtcacaggcggaacatatcaaaaagacgcactcaaaattgctccgtccattatcgatgaacctgactgggaatcgccggtcatgcaggaagagattttcggaccgatccttcccgtcatcggctatgaaacgatcgaagacgttatccaaatggttcaaagccgccctaaaccgctcgcgctctatttgtttacgaatgaaaaaacggtacagaggcacatcctcagccggatttcatttggcggaggatgtatcaatgacacgctgatgcacacagccacaccttacctccccttcggcggcgtaggcgaaagcggaatcggaagttaccatgggtatcacagctttaagacgttttcccatgaaaaaagcgttttaaaacagacaaacctgtttgacatttcattccgttatccttcatcgaaaaacgggctgcggatcatcaaaaaacttctcaggtagacaggagccagacaaacgaagaaccgcttttttagcggttctagcgattaaagattcggaagggaccagtcaatcggctcatccccgatttgttccaaatactgattggctcttgaaaacggtctgctcccgaaaaacccgtttctagccgagaacgggctcggatgcggcgattggataataaaatgcttggatgtatcgattcgttcttttttcatttgggcatgccggccccagagaataaaaacgaccggtttgtctcttttgtttaaaacatctattatactatctgtgagctgttcccagcctttccctttatgcgaatttgcctggccccgtctcacggtcaaaacggtgttcagcagcagaacgccttgcttagcccagctgacgagagaaccgtgattcgggatgtcggcgccgatgtcattctgcaattctataaaaatatttttcaaagaaggcggtggattgacgccgggttgtacggaaaaacttaagccatgggcctgacccggaccgtgatacgggtcttggccgagaattacgactttcacattttcataggaagtataatgcaaagcattgtatatatcgttcggttcaggatatacggtgtgttcagcatactcccttttcagcatttccctcagttcttgataataaggcttatcaaactcgtccttcagctgttgccaccagctgtcattcaaaatctgtttcaatgttcaggcctccttagttcaattgtcttgcagcagtgagcctggatgcaaccggttttccatcccagacgatttcgctttccgcttccctttttttcatggcaggttcttcgagtagcacgaaaaagttctttgtcggcagcttgccaagctgatgcttttcactcaagacatccaagtaatactgcctcattccgccaagatctccggactggttgtcaccctggtctgaaaacgcatagattacgcttgcgaaaggaactcttttcacgcgaaaccgctcagccgctctcaggaaaaagtcccaatcccaataattgtggacggcaggatcgaagtagccgatttcgtcatgaagagatcgtttgtacatacttcctgaaggaacatatgtagaaaacttcctcatttcatccaagttaaaggaatacgcaaaaaggtaacggcttgtcggaattctcatatcctctttttcttcaaaagacacaatctcagcatccgaataaacaaaatcggcggtctccagcgcattcaacattctctccatatggcacggcgtgaaaaaatcatcatcatcacacagcataataacgtctccggaagcttctttcacccctatatttctcgcttttacatgcttcacgttttctttcagatgtataactctgatcggaagctctgaataaaggcgctcaacaaagtcgacgctctccccggcatcattaacaataataacttcaaacggttcaacagactgttttgcaatagattcaagcaattcgcacaaagcggtgacccgattatgcgtgacaactacgatagatatgttcatgtttgtgatatacgctccttcttatttcattctaaacatattaaagcataatgcgaataatttcacatggatcaaaagatggtctggttttttatgccaatccattcacgaaattttgcagaggaccgctgcactataaagcggcagccatttcattgtgatcttgcgaaaagctgtctataataagtaataaaccaactttggatggaatctcttatcgtggaggattgactgaacatgacaatgcacaaagcactgacaatcgccggctctgactcaagcggaggcgccggcattcaggcggacttaaaaacgttccaggaaaagaacgtctatggaatgacggcccttacggttgttgtcgccatggaccctgagaacaattggaatcatcaggtgttcccagttgatacggaagtcatccgcgctcagctgtcgacgattgtggacggcatcggtgtagatgcgatgaaaacgggcatgcttccgacagttgacataattgaattggcggcagacacaattaagaagcacagcatgaaaaatgtcgtcattgatccggttatggtatgcaaaggggcaaatgaagtgctgtatcccgagcacgcaaaggctttaagagagcttttggctccgcttgccacggtcattacgccaaatctttttgaagccggccagctcagcggccttggagaaattaaaacggttgagcaaatgaaggaagcggcaaaggccatccacggcctcggcgcccaacacgtcctcattacagggggaggcaaactaaatcacgaaaaagcggtagatgtattatttgacggccgggatgcagaggtgatcgaaggagaaagaatcgacaccccatacacgcacggggcgggctgcacctactccgcggcaattacggctgagcttgccaaaggttcaaatgtaaaagaagccatttattctgcaaaagcgtttattacggaagcgattcgcgaatcgttccgtttgaatcaatacgtcgggccgacaaagcactccgctttacgactcagcggcaaataaaaaaagccccttttatgtaaaaggggctttcatttagctttcccgtttgatcgttcttgcagatgatcttaagaaagattcgatcgattccacaaaaagagcatattctttcatttgttcataagtgtcctgaagtttcttttgtacttcctcatcatttggaattgttttatcttcaataccgccgatcagcttcttcatctggaggagcaaaccattgtattcctctctcgtatcctcaatatggtccgctatttttttcaaacgcatagcggtcaatttctgctggttttgatccacaaaaacaacccctttatactgcactctctctaaaaaaagcatatcataaagggattgtacagaaaatagcaaacagcagccgctccctttatgccattgtccaggatgtcacattcattatgatttcttttctggcactgatccaaacatcattatttcccgggtaaggaaaatatcttgccgtaaagacttcctctccctcattgacgaagatttcaatagaagaggcgtctaaaaagatgtttaaattgcgaagctcctgcaaacggcactgtctggcttccgttttttcatcaacataactgtttctctccaaggttatgatgccttctgctttattgtatatgagtcgggctgcacccctgaaggaaatctcaaaaccctcttcaataactttcggactgatgaaaagctcagctttgtccggttgaacaatgtccaatttttcggtgccttgattaagcgatattgccgcgtttttttcgttttggcggagcgttctaagctcctcgaccggtttttgaacgattttatcgttttgtaaatgcaattccctcggcaatgtcatacagtgcacccattgatgcggaatcgtcggctggctctgttcatcttggtctggaacacccatccaggcaaccaatatcctccggcctgattcgtcttttgtcgtctgcggcgcataaaagtcaaagccgcggtcaagctcttcgaaatctccgtgtgtaaaccagggtttcagctcgttcaattcaccgacaaaatagcctgactgatagacgttttggtagagcatctcttctgcttcaaggccttgcggacagacaattaagacgtctttgccgtccagttcgaacatgtcagggcattcccacatatagccgaattccccgagctgatctgtatttgaacctgtgatatcgccgaggaactgccagtccttcagattatccgattgaaacagcaccgcccttccctcaagattttcagtctgggcgccgagcaccatgtaccagctgccgttctttttccatactttcgggtcgcggaaatgagccgtataccctttcggaagccttgcaacaaccccctgcttttcaaacgagatgccgtcttttgagacggcgagacattgataggtctccctatttccctcgccgtctctgacattccccgtgtaaaacagatgcagcacatcattttcagcgatcgcgcttcctgaataacaaccgtttttatcaaaccagtcgctcggcgtgagggcgatctcttcatgccgccagttaaccagatctgctgaggagtagtgtccccataactttgcaccgtgccccgttttaaaaggcatccactgataaaaaagatggtacacccctttccactgaatgaacccgttcggatcattcagcagtccgacaggaggcatgatatgataatgcagccgatagggatcaaggtttacaatatcccggtattcttcaacccggttcattgccttttgacgaagctcctgatcttgattcatcgttttccctccctccgtcactttttctcgtcttcattaatgcctaagataaaggctgtgataaatgcgacagtcacagaaatcgccattccgattaaatagtggatcaggttgcccattccaagcggggcgacaatcgcaatcatcggaattcccgtcaaaccgtatgcgtttgctgcaacattcataaagacaacgtatgcagctcccagcgctcccccggccattgccgcgataaacggccggcggtaacggaggttgacaccgaaaataacaggttcggtaatgccgagaaaagaagagaaagcggcaggtaaagcaatttcttttgtttttgcacgctttgccaaaaagaatacggcaagtccggccccgccttgggcgacattggacatagaccagatcgggagcaggtagttcctgccgatatcagcgataaggccggcctcaatcgcatggaaactgtggtggacaccagttagaacgatcagcgagtatgttcccccgaaaatcagtccggcaacaggcccggcaacgtcatacacatatgttaaaatgttcgtgatccctgtaccaagcattcttcctaaaggaccgatcgcgataaaagcaatgaatcccgttgaaataatcgtgacaaacggtgttactaatagatcgatcgcatttggaacgattcttcttacgcctttttcgattttactcatcacatatacggcaagcaaaattggaacaacggttccttgatagccaagcatctcgattttgagtccgtaaaagtccatcacatccggtgatgcagttgcaagtccccaaggattgaacaagctcgggtgaattaaaattcctccaagtacagcccccaggtaaggattgctgccaaactctttcgcagcactgacaccgatcaagatcggaaggataataaatgccgcgctcgagaacatatcaagcattttatacagcgccgcatcaggatcgacccactgaaatgccttcatcattcccaacagccccattaataaaccgcttgcaacaatggccgggatgattggcacgaaaatatttgacagcgttttcgcaaatcgcgctaaaggattcatttttccctttgcggcatcgctgtgctgaaccgtttccttttggtcaagattcagctctttggcaaactgttcatacactttattaacaagccctgttccgaaaataatctggtattgaccagagcttgaaaaggctccttttacaccttccagctcttcgaccttttccttgtcgatttttgcttcgtccttaatcaccaaacgaagccttgtcgcacaatgagctgcactgatgacattatcttctccgccaagaagctgtataagacgtacagcgatttctttatgaatcatgatgactcctcctttttttttaaaaaaaagcagaaaagacctaaaattcaccaacgaatggaggatagattttccccattcatctagcaaattttaggtcttgcctgctttaccagtcacaatccccggtatttattttttaatacgctttcattttattatgtgataacgctttcgtcaactacttttttattctctgtgaaaatcgacctaaaaaaagcctgatcgcgcgatatcaggcggtattacctataggaatcatttaaacgctggacatgcagcgtaatatatccgacttctgattccggaagatgaagatcatattcagtttttacgtaatccgccagccctgccgcacatcggtagctttcaggatacttttgccggatgaaataaagcatgtcatcgtccatgacatgaaacgcttcatttgattccagccggttgatggcatacctgagatgcgtgacaagacgctgatatgagatgctgttttcgtcaatcttctgattgaaacagcattcgattttttctatcaattctttgatgatgttcgtgtattttagagtcttctgcatgttttccgcatccatttttgcggtatgaatatgcagcgcaatataacccgcttcatcatcaggcaattcgactttcagtttttctttgaccaaatcgattgcccagagtccgatctcatattcttttttataaagcgctttgatttcatttaacaatttattttgaatgacgaatcctttgcggactcgctcgatcgcaaatgacaaatgatccacaagggcgatgtggatatgatcgctcaacggtgcggacagctccccttccgcatagctgatgatctcttcggcagcttcaatatgttcttccggaagtgtttcgaggatttgtttaaacttttcattttcttcatgaatggtaaaaattttttctaccttgtttcttggaatggtatcgtttttgcctttttgaaaagcgataccaggtcccatgacaattttttcttgaccatcctcctttatgattgctgcattgttgttcaatactttatagattttcaaagctgtcacccacttcccattatgagtgggattttaccttgtttaagttcccgtgtaaagagttggtccggctcttacccttttcaccgcttttttgcaaacagcccggctgggttctgtcgtataactgccgggcttcattctcttacagcccgacatccgctctgtcttctcttctcttttttccgaaaagccgcctgcctgataagcatcggcagcctgatatgtaccgccggcgaacgccgtcaccttcatctgattttctctgacaggcatcaccgcattcagcagcacggctgtccataattttaaaaatgatatcaaacctttcataccgatccctccagtttcgttttgataaaactagcaactctattaaactttcttgctctatcttatcccagcaaaatgaaaatgtttgtcacaatgtgtgtgcaaaatgattctagtttttagaagttttgttgaaaactgaaggaatcgcatgattcagcggatacaaaccatgaatgtaacttactcacagcttatcctaaggataaacacatattacccacaggatatatccacatatccacatacttattcaatatttagtataagaacgtatattccctacaatatctatacacaagtttattcacttatacacagtaaattgtgcataaatctagagaaatccactccaatacattgaatctttgaaaattatttctatatatagaaggatttttttgaaactgagagaatattttaaaagttcgaaactctaataattacaaagaaacatttatccagaagggggaaaacagattgagaaaaagtatcgtgcgctattttgttatggcttttattctattatttgcgttatccacattcctcaccggagtgcaggcaacttccgttcccgataaaaagtcgcctgagcttgagaaagctgaaatctacggtgatattgatgtgacgtctgataaacagacgacggttatcgtggaactgaaagaaaagtcgcttgccgaagcaaaagcggacggagaaaaacaaacgaaggcttctctaaaaacagctcgaagcaaagcgaaaagcaaagcgctgaaaacacttaaaaaagcgaaagtaaaccgcgaatacgaccgtgtattttcgggcttttctatgaaactgccggccagtgaaattccaaagctgctcgccgtcaaggaagttaaagcggtttatccaaacgcaacttacaaacctgacagcgtaaaaggaaaagacgtgacacttgcagcagacgccatttatccacagatggataaaagtgccccgttcatcggagcggatcaggcatggaaatcgggctataccggtaaaggcattaaggtagccgttattgatacgggcgtggattacacccatcccgacttaaagaataatttcggcccatataagggctatgactttgtggataatgattatgatccacaggaaacaccgacaggcgacccgcgcggcggagcgactgatcacggcactcatgttgcaggaacaatcgccgcgaacggacagattaaaggcgtggcgcctgaagcaacgcttcttgcttaccgcgtgctcggccccggcggctcaggcacaaccgagaatgtgattgcgggcattgaaaaagccgttgcagacggagcaaaagtgatgaacctctcattgggaaattcgctgaacagccctgattatgcaacaagcatcgcactggactgggcgatggctgaaggggttgtcgccgttacgtcaaacggtaacagcggaccggaaaactggacggtcggctcgccgggaacatcaagggatgcgatttccgtcggcgcatcacagcttccgtataatgagtattcggtgacgcttccttcgtattcatcagcaaaggtgatgggataccaagaggaaaaggatcttgaagcattgaacggtcaagaggtggaactcgttgaagccggcctcggacaagctgacgatttctcaggcaaagatgtgaaaggaaaagttgcggttatccagagaggcgtcataccatttgttgataaggctgaaaatgccaaaaacgccggcgctatcggagccgtgatttacaataatgcaacaggggaaatcgaggccaacgtcatggggatggccgtaccgaccgtcaaattgtcaaaagaagagggcgaaaagcttgttcaacagatcaaagaagggaaacactccgttgtcttttctttcaaattggacaaaaagctgggggaaacaattgcctcattctcgtcccgcgggcctgtcatggatacatggatgattaaacctgacgtttcagcgccaggcgtcaacatcgtcagcaccattccgacccacgatccgaaaaacccgtacggttacggttcaaaacagggaacaagcatggcttccccgcatgtcgcgggaacggcagccatattaaagcaggccaaaccggattggacgcctgagcaaatcaaaggcgtactgatgaatacggcggaaaaactgacggatgaaaatggaaagcctctccctcacaatacgcaaggagcgggcagcatccgcatcatggaggcccttaaagcttcatccattgtaacgccgggcagccattcatacggaacattcctgaaagacaaagggaaacagacgaaaaaacaagcgttcacgattgaaaacctttcttcacacagaaaagcctatcagctcgaatactcctttaaaggaacgggcatcacggtatcaggaacggaacgagtcgtggtaccggccaatcaaacaggtaaagcagcggcaaaagtaaccgtcaattccgcgaaaacgaaagcaggcacatatgaaggcacggtttacatccgtgaagacggaagaaaagtcgccgaaatcccgctcctattgatcgtcaaagagccagactacccgcgcgtcacatccgtaacagttgaaccgggagcaaagcagggcgcttacacgatcgaagcctacctgccgggcggggctgaagagctcgcatttctcgtctatgatgaaaacctgaaccttctcggccaggccggcgtttacaaaaaccagggcaaaggctatcaatcttatcaatggaacggcaaaatcaatgacgccgcatcccttaagtccggaaaatactatatgcttgcctatgcatccgccaaagggaaatcaagctacgtattgacggaagacccttttatcgtcgaataatgacaagccttgttgagaaccactcaacaaggcttttttatgttaaaatacggataatgcgttcaggagaagctcccccttctcttcaaaacgtgaaaaaagcaatcggaggacatcgtgtatatgctttcttttatcgtattattcggcttatccttcattattgtctgctttatatttttcacgattttgtacttcgccgtcaacctgcagaagcgcgagcccaagccttttcaaaaagctgcggagcaaaccgtcgataccatcatcctcattccgctcagctggctgtttaccgctttatacatatgcattctgtttattcttttcccaatccgccattttctcgatttttttcagcaaaaacgctaaattgactgatgaaacgcttcggccagcagccggtatgaatccaatctgtcttgaaaatcgtgggtgatcgtcaccgccatgatttcgtccgttccgtaagcgccggccagttcaagcagctgttcctttacctgctgcggcgttccgatgaccatccgttttcgattgtcttccactctctttctttcataaggagaatattgataggacagggccgtttccaatgatggaaagccttcggtcaccatcccctgttcattggccaataaagaaaaatccaagcttttggcaaggttctccgctttctcttctgtctcagcgcaaatcacaaatacggcaacgatcacatttggctgttcccccaatacagaaggttcgaacctctctttgtacagtctggccgcctcttctccgccttcaccgttaataaattgagcaaatgtatatgatgcccctgtttgggcggcaagccttgcgctttcccctgaggagccgagcagccaaacagcgggcgctgtggcgatgttcggcgttgcggtcaagttgggaaagcggtgatgttcatcggcttgatcgtataaatatgtgacgaggtcctgaatttgttctggatattggtcagccatccgtcttcctccattttgaagggccattgaagcgatcggcatccctcccggagcacgtccgacacctagatcaatcctgccgggcgcaagtccttccaagacgcggaagttttccgccaccttgtaggcgctgtaatgcggaagcatgacgccgccggatcctatacggatcttctctgttttagccgcaagataaccgatcagaacctccggacttgaccctgccaagttcctggaaaaatggtgctcagaaacccaaaacctcttgtatccgagccgctccgccgcttgcgcaagctccaccgtatgctgcaaagccagttcaggtttgcttccttcagaaacaggagtctgatccagtatgcttaatgacaacatctttttcaccccaaatcttcgtttactttttctgcgcaaaaagaaataatagtatcatggataaactaaaggagctcccagtactgatgaatgagacgaagcaaaaaacgcacccgccagccgtagaagaacgctttgcaaaaggctgtttattcggaatccttttcagtctgcccttttggctgatgttttatcttttccttcaatacatgctgataagataagtcccctccgagtcggaggggaggttccttaccttttgttcaaaccttttcctttaacgaattcattcatatacgcacgcggcggctttttgaggctgccggtgatctggtctgtccatttgtcagaccgtttgccgtccgtccgcttttgataatagtttgaaatcgtttcgtcatatgcggacaaatgcttttcaaactcggcatcatccgcttgatagacattttcatgataaatgtgatcaagcggcagacgcggttttttggccgaagggttggccggctggccgacgacaagcccgaacagcggaagaacgtattcaggtgtttcaagaagctcggagacttcgttcaaattgttgcgaatcccaccgatatagcagatgccgaggcccattgattcggccgctattgacatattttgagcggcaagcgctgcatcgatgacgctgaccataaaggtttccgtcccttcaagagaagctgtaatatctacaccctttttccgagcgattttgtcatgcctgtaaagatctgcgcaaaatacaaacagatggccgtttttttcaacatatggctggttcccggccaattccgcaagcttgcgcttcttgtccggatcggtgacaccgatgattgaatatgcttgaatatagcttgacgtcgatgcgctttgagcgctctccacaagcaggcgaacctcttcttcggtcaggagccgatctgtaaaagacctgatcgaacggtgatttaaaatagtttcaatcgttttattcatcctcttacctcctcaacctttatcatatccaatatctgcttttctctaaagcaaaacggtttggcggactgcagatggattcaatttcatatggtaaaatgatagaattgtcttactattttcgaatcggaaagggagatgacggtgaaatccgtaattgaagaattagatgcattatttccggaaatgatcgaactaaggagacattttcaccaatatccggagctttcccatcgcgaggtcaatacaccgctcaccattgcaaattacttggaaagcctcgggattggcgtgagaacgaatgtcggcggccaaggggtcgtcggtcacattaaaggcggccgccccggcaagacggtcgccttgagagccgatttcgacgctctgcctttacaggatcaaaaaaatgttccgtaccggtcgactgtccccggcgtcatgcatgcctgcgggcacgatgcccacacgtctgctctcctcacagccgcaaaagccctggcaaagcatcgaaaagacttgaagggaaatgtcgtgctgatccatcaattcggtgaagaggttacaccaggcggcgccaagccgatgattgaagccggctgtctcgaaggcgtggatgccattttcggcacccacatctgggctccgatgcccgtcggtcaagtcggtgtcaaatcaggcccgatgatggcagccgctgataaatttaaagtcacgatatccgggcggggcggacacggaggcgcgcctcacctaacgacagacgctttaatcacgggagcctcggtcgtcaaccatctccagcaaatcgtcagccgcagaatcgatccgacagaagcagccgtcttgtcgatcggaacatttcattcaggccaggcatttaacgtcattgccgaagaagcggtcattgaaggaacggtccgcaccttttcaaagcatgtccaggaaacgatcatcgccgagatcgaacgcgtaattaaaggcgtctgcgacagcaacggggcctcgttttcactcgattatgaaaaaggctaccccccctgtcgtcaaccatgaaaatgaaacggacatcgtccgtcaatgcgccaaacatgtcgtcggccctgaagccgtcatcgaactcgaaccgaatatgatcggcgaagatttctcttattatcttgaacatgtccctggatcattcttttttaccggcgcgggcaatccgcagactggagccgtttacccgcaccatcacccgatgtttgacatcgatgaaaaaggcatgctgaacgcggcgaaaattcttgtgtcggcggctctagcatttttaaaccaagactaaaaagacagcctgattcggctgtcttttttatttaaacatatagcctttatatttcgtcagctggcagctggcgttataaacgatcgcatagccgatcagcgcggacaatacagagctccctccgtagctgatgaacagaaggggaacgcccgtaaccggcatcagcccgacgttcattccgatattttggaatgtgtggatgacaatcagcgccgtatacccaacacagaaaaacgatgcaaacttgttgtacgggtgtatcttatcaatcagcacgacaagccggtaaatgagaaggaaaaacatgatgacgacaaatgtacagccgataaagccgaaactttcgccgatgacggcatagatgaaatcggtttggccttcaggaacgtatactttcaaattgttaatgcccgttccgaagatttctcctgagccgatcgccgtaacggctttttcggtctgatacgtatcattcgcgtcctgctggctcgaatcgacccatgtcatcacccggttgatctgatattgctggatatgcaatgtatcctttgaaaactccggaaaattgatcaccaaaaacagaacgagcagtacgagcgtgatgcccgatcccgcgactatgaaaatcagcttccagttcacgcctgataaaaacaccataacggcgacaaagaacatgcagataccggccgtaccggcgtcctgcattaaaatcaatccgaccggaaccgccgacactcccgcgattttcagcaacaggcgaacatcctcctgcatcgagcgcgagcctttcggacttgctttggaaatcaccgaagccagcatcataatcaggccgattttcataaattccgacggctgcagcgtgatcgtaccaaattgaaaccagctttttgcgccgtttttaatcggagcgatcgactccggactaacttttaacacgagcaacgacaagatgccgaataaatatatgtaaatgcttaacttttcaagctgctccagatcaaaatagagaaagccgacgatcaccgaaatgccgagcagataaaagaacaattgctttgccggataacccttcggtgaaaaagacggctccgcagcgtaaacagcgatcacactgattaaaaagaacatggctaatataaaaatcaaatcgccctgataatagggacttgtcgtatttttcttctggcccattataccccgccttatttcttcatcaaaagcactaactttcattatagcatgaacaaccgttcacattgcgaaaaagggtgaataaaataacagcccgcatacatcaggctgttatttgaacatatagctttgatactttgttaactggcagcttgaattgtagacaaccgcgaagccgagcaaggttgctacgactgagctgcccccatagctgaccaaaagcagcgggacgccggtcacgggcataatgccgatattcattccgatattttgaaaggtatgaatgacaattaaagcggtaaagcccgcacagaaaaatgaggcaaacctgctgaacggatgtattcggtcgatgagcacgacaagccggtaaattaagaagaaaaacataatgacaacaaaagtgcatccgacaaacccgaagctctcgccgatgacggcaaaaataaagtctgtttgcgcctcaggtacatagacttgaagatcgcttacaccatttccgaatacttttcctgaaccgatcgccatttgcgccctttcgacctgcattttatcgtcggcattctgttcgctcggattgacccaggtcataacgcggttgatttggtattgttcaaccccgagcgctcccgcaacatcgggaaatttgatgatgacatataaaatcaaagcaacggctgcaagacccgttccgaagataagagaaatcaatttccagttcacgcccgacaggaataccatcacaaggatcacaaacgcgacgatcccggctgtacccgtatcctgctctaaaatcaagccgaacggaacaatgatgataccggcgattttcagcagaaaaatccagtcttctttcaacgtacgcttgccgacagggccgtttttagacatgaaggaagccaagtacatgatcagcccgattttcataaattccgacggctgcagcgtaaacccgggaagcataaaccagcttttggcaccgttgatgaccggcgcaaacctgtatgatccgatatatgccggactgaactttaacacgatcagcatcaaaatgccgagcagatagaaataaaagctgagcttttcaagctgctccaaatcaaaataaagaaacacgatgatgatgaaggcccccagtaaatagtaaaggcactgtttcatcgcaaagggttcattatattgattaaactgctgagcagcgtacacagccacaacgcttatgataaaaaagacaatatagacaaaaatcaaatccccctggtaaaagggatttgtaatattctttttctgactcattcgaaatcccgcccttataatatgacacaatgaattaatgcaggaagacggcatccgcttcctcacaaatgatatgacgtacaaaagaacaaaatgtttcgattttattgcgaacaaattcctattctattttaaaggatttttccaactattgtcgaatgtgataaattcattgatttttgcttgaaatgtattaaaatgagtaatgttgcataaaattaaacttttgcctccggcagaagtggtacagaatcaccaattcataaggagtttttcatttggataaagcacttcaaaagcgtaaacggcttgatatcataaaatttttggtcccttcgcttatcggaattattctgtttatgattcccgttaaaattgaaggaaatttaacgattccaattgctgttttttcaaatgcattgcaggagctgcttcagcagcaattgccgctgatcatgacggtcatcgtaaccgcaacatttatcttaacctttatcaccaaaacctttcatccggctttcatcaaaaaaagcgagtttttctataacctgctgaatgtatctttattttggtatatcgtccgcctagtcggcatgattttcgccgtgatggcgtactttaagatcggacctgaagcggtgtatgccaagagtaccggcggaacattattattcagcctgcttcccgttctcttctccgtctttctatttgcaggcctttttctgccgtttctgttgaatttcggcttgctcgaactgtgcggcgctttgatgaaaaacctgatgaggcctgtctttaagctgccggggcggtcatcgatcgattgtatggcttcatggctcggcgacggcacgatcggcgtgctcctgacgagcaaacagtatgaagaaggattctacacgaagcgtgaggccgccgtcatcggcacgactttctcagtcgtctccatcacgttttgccttgtgattatttcacaggttggccttcctcatatgttcgttccgttttatttgacgatattgctggcgggtgccgcagctgcggtgatcagcccgcggattccgcctttatcaagaaaggctgatacttatattacagatcaagcggatcaggatcaagagaagattcccgaaggatacactccgttccaatgggggctcagccaggctgtcgcaaaagcaaaacaaaatacaagcgtcaaagatttcttgcaggacggggctaaaaacgtactcgatatgtggatgggcgtcgctcccgtcgtcatggcgctcggcacagccgcgctgattgtcgctgaatatacgccggttttcaaatggcttggactgccgttcattcctcttctcgagctgctgcaggttcctgaagccgctgaggcctcacaaacgcttgtcgtcgggtttgccgacatgttcctgccgtccgtgctcggaagcggcattgaaagtgaaatgaccaggttcatcatcgcctgtgtatcggttacacaattaatctacatgtccgaagtcggcggccttttgctaggttccaaaatcccggtgacgttccttgacctcgtcttgatttttctcgttcggacgcttattacgctgcctgtcattgtactgtgtgccaactttattttttagacaaataaaaggctcccggcgccaaatgccgagggccttttttgtttagaaaaaaatcgttgatccaaggggtctgcggccttatcgtacgatccgcctgtccgcttcttcgcttcccgtaagcctgccggcctcgtataggaaacgcgcggttcttggctaactttcgcatgatcaatctcctccacgcattttcgctattcacttcttctccccttcaccctttatgtcctaactgaatcaccgtgaaaattgagccgatagttggagcggaaaatgctttccagtatgtatcatttttcgaagaacgtggtataataaatgtaacagaatgttcacaaaatattctccaattagacacaattgatgtttcattccgctttttttgacagcgctatcattatcgaaaggggctgaaaacgcatggatatgtttttcgcttacttgctgattgcaagcgccactcctttatttttatggctggacaacaaaaaggtcgcaatttcttctattccgcccatcattttaatgtgggtattcttctttttctatatgaccagcagcctttctcctacaggacactctctcatgatcgcactctttattctcaacgttgtcatcgcccatgtcgccgctttcatcatctacggacttccattgatccggaagcacatgagccgataaaaaaagtgccggtttttccgccggcgcttttttgctgttaaacgcaactatagatcaaagttaaatgttgaatgcgagtaatctttgatgaatgtttgataccggctgctgaagtcaagcaggcggtatattttcgatttttccgcaaaccgcttatggttgtctctggccggataataaacggacatgccgcttcctcttggatgctccggagatttgatgttcatgatgacagccttcttgacggattttacgacctcttttgcttctttctcggctccgatctgctgaccgatcaagcttgacaaatccgccaaatcaaccatatccgattcatctgcataatcttcagcagcgagacgcgcgtagtggagcaggcgctttccgtcaggctctttcaatgccaggttcatgtttacgctcaatctgtcgagggcatcgacagcgtctttgacacggttcaattgaattaaagactgctgcaggtcttctgtttcaccgttttcttttgactgctgtacgtagcctgcagcgatttccctgccaagctctttcggatcgattgaagggtcgtcttgtacagactgcagcgcccttttataatcccagccgttttgattcgtatagtcgactgaagccagcatgtacttaccataatccctcaaggcatatgccgtttcaatcccggccattttgcagttgtcaaaaccgattaaatcaaacttttgcttcgtatgttcataggccgttttgattcccgactgcagctcgcttattttcattttcttattgccgaagttttcgtctcccccgtagccgtcaactgagccaagcccatgcccccaaaagatcaatacatattttttagccggatatgttttgactccccatgtgataaaatctgtgacggagccgggactgtccatatttttcttcccgacattttcgaggggcaccagcttctgatgttcaactttccacctctgattcaccttgtgactgatcgacgggttcgcccatttttttgctcctcctgtctgaagaacgacattgacgtttgaagatgaacccgcatccatcatttcctgaatgtcatcgcttgccatatgaaaatcgctttccatgtcagaaccaatcatataaacaagaatagtatagtcgtccttttcttttaatagagcggctggtgccggctgaaaaaaggcgaatgaaataacggaaaacaaaatccatttgatcaagttcatcttcttatgctccttatttaagattccgggaaataaataagagagtagtagcagtcttcgtccggctgttcgtgttccaatgaatacccgacggatcggaagcacgctaagcacctcttgttatcctcttcaattccggcgaaccatttgttgatccggctcatttccggcaatgccatcgtccttttgatgagcgcttttccatatccccctccgcgcaaaaacggatcgactaaaagggcaatgttcccggtcaagtcctcctcaacttcaaccatgacaacgccgacaggcttgccgtcctctaaagccgcccatacccggtagttttcattaccgcctgcaaaattgaaccattcgtcaagagggagcatcccttccagccgccttttcacctctgcatcctcaaaccaggtctgcagccattcaatatcttcttttcgaaaaagacgaagttcttctatattgctcattgctttctcctttattgcgcgtatttttcagcttgcaggcgataaagctctgcgtactgtgcctgatttttcatcaattcttgatgggttccggcctccgccacccttcctttttctaaaaagatgatgtggtcggcaaaacgggccgtgcttaaccggtgcgagacaataatgactgttttgccctgcgtcagcttttgcagcttatcaaatatctcttcctcaataaatacatccagcgcagaagagggttcatcaaatattaaaatgtcggcacactcatcacgcataaatgcgcgggatatggcgatccgctgccattctccccccgacaaattcctgccgccgaacaatctgccaagctctgtttcatagccgtcttcaagcttatgcaaaaactgatccactccgccgaaagccgaagcactttttattttggccaagtcggtgcatgaagaaatgtcgcccagaccgatattgtatttcaatgtcatttcgtaccgcaaaaaatcctgaaacacggccgcggcatttgaccggtaatgctctatatcatacttataaagcggtaaaccattatacgagatcgtgccttgattgggatcaaaataacgcagaagcaatttaacgagtgtgcttttgcctgatccgttttctcccacgagaacggtcgtcttattcaatggaatatcaaactgttgaatatcaagtaccgttttggttccatcataagaaaattccacttgatcacatgtaaatcctttttgcttttgaacagctggagcggtttccccattttccatggaatttttgctgtttaaaaaagaatgcacatttccgaggtgcctcgtttctcttgctccgatcgcaaaagcagcgaacatttcattgattccttcattgaactgaaccgcggctccgataaacagcatcacatccccgatggataatcccccatgaaaagcctggtgaacgatgtaaatcaggacggcacctgcggccaaagattgtaataccgaccagaacagctgatacagcgccagttttttttgatcgttggacagcgtatggaggagctccatcgaggtgtttttataaaaggatttaaaaaaaggaacaagattgtatatcttgacctctccggctgtttcagacataagagggacacctgcataatattccgcgcgccgcctcagttcctgaacctctttccgtccttcaaaggtcgcgttgtttaacttcgcctcccagtacagtttgggaacggccaatatgagaaacagcagcggcacccacggtgcagccatgccaatcaataaactgctggctgcaatcatcaccattccgccgaaggtttgagacacgatggaaacccacatcgtgacaaaatattcattatagcggatgatttgtgtattggtatgaaaagatgcgtcttcaaaagccgcgatatcaggaatggaaattgcctttttcatgagcatttcatcaagataagcttcgagcttggcggtaaggagccttttctgcatttcagctacaggctgaagggcatctacgatcagcgtaaaagcaatgtatgcaaaggccgcccaaaccagtgcattccaagaagacagctcaaacggcgcccgtgcaatctcatcgatcacctctgcactcagccagactaggagaggtccgagcattgcattcagcagtgtaattaaaaacagaaccgccgacttaaaaggatcgcagcgccaaaacaacgttaaaccgtaaaatatgatggaagcggtttgaggcagctttttgaaaaacgaataaaatttcagcaatatacctcatccttcccctgaaacgatttggcctgcatgcggaacattctgctgtattccccgttcttgtccataagttcctgatggcttccctcttctgcgattcttccgtttttcaaaaccagtatgcggtcagccatctttaccgtactgaaccgatgggaaatcatgatcaccgtttttccctctgtgaagctttgaaactgccggaaaatatcatattcagcccgaatatccaaagatgcggccggctcgtccaatatgacaagtccggcatctttcataaacgatctggctaaagcgatccgctgccattggcctccagaaaaatcggtgccgccccattcagggccgatcattgtttccagcccttcaggcaactcttcgacaatcggttccagcttggcggcccgagcggcggcgcgaagtttttcttcatcgcctaaagcttccgttcggcctatcgcgatattgtgccggagtgacaattcgtatctgccaaactcctgaaacacgaccgccattttgtttctcagctgttgaagatcgaccttgcggatgtctttgccgttcactttaatctcaccctcatcatactcataaaaacggcagagcagtttgatgagcgttgttttcccagatccattcgcccctacaatggcaattctttctcccggtgatactgaaaagctaattcgattcagaacatagcctgtgtgcatgtcatacgattcaggctgttcgtcttgtccccgcatctcttcatcttcaagctcatcgagcatatccaagtcttcctcatccacatcagcttcatttacccgggagccggcagccgcttctctgaaaggatagcggaaggtgacatttttgaattcgactgccagcggtccttcgccctcgagagattcgccattggaaggaagcctgatatccttttcggcgttcataaaaagaaaaaagtctcttcccattctccatatatccaacgtatctgcaccttctttggcgatatcccggagtgccgttgataattggaacacggcccccaagtacagcgatatatcccccacagaaaaactgcttgaatgggattgggacagaatccaaaagtaccccaaacccgttcccgcccccgataagaaacccgttaaaaccgaccagcgcgcgcttctgacctgaatattccgcagcacagaatataggcctttaaaagcagattgatataaatcaagaaagaaagaccccaggccaaaaaggcgtacttctttggccgatcgtctcccgagcagaatgtggcgcgcatatgcggccctccttcttacaggggcataatccttgtgatattcccactccatttcattgtaatgattatggacaaaagcaaatggagcggtcgacaaaataaggatgaaagcaaggacgggcgacagataggcgatgatcaaaacgacgcccgccaaagacataacggcggtcaccaagttcgaactgatattaatgaattgggaaggaagccatgtcgaacgatcccgcagtgtttccagccggtccctgtactttggatcctcaaaaaaacgcatccccggaatgcggtcaaaagcgtcgatcaacaaactgttgactgtgatcatcgacctctcagaaagcattgccttcacccatttttccaatgatttaacgacactgaccatgaccaggcttcccgcataaatgacagcccatatttctgcatagatgacggcttcctgatcgacaatgccgtcgatcatttgctttgaagcgtacaattggattaaaggtgctccggcttcgatcagcatgaagataaccatgcaaatcatcagccgcggaccggatttccagaccattttcccaagcaggcccgccgtttgcagcggctcttgaatatgcttcatcttccacacatgcttcaccttcattttctatacctattgtggtcattgatacgagtatattttggctttctccggcgtattgacggtttcgatatcagccatgacccttggctttaccggacggctccggtcgagaaggtgctccttccccttggatgcttctcttagccatatttccaagtcaataacagatctcatgtactgatagcccatgcccagatcattatttggatcttcagagcggatagccatagccagcaagtgtttccaccatatatcgcgcttaatgatgccgagttcttcaacgaagacgcgctctcccggctcaaataactgaagaacgtgtctgcggtcattcataaagcttttcctggccatatgggcatatgttgttttcgttgatctgttataaacataggcaggcaggatatcggtgaaagatttgcgaagaagcattttagagcctgcataatgttcttcaagcccttttaaaacatcaaaatgctgttcaggcggtacagaaaatgagaactcgatcagccgccggtccaaaaatggatggtacgtatgcaatgtcacaccaacagcatccatgtacctcgctctcggccacaaaaagtcatagtgaaacctcttgccccacactgagagctcccggctttttcgatagcgtagatgatcctctttattgatctcccattctctctttcggtgttcttcagtgaaatattcaggcagctcatattccgtatctgaccacagcaggtcgtaatagagcttttctccaatataaggcatgaaaggggcgattccgtattgaaatccgagcttcagcatctctttcatgctgccgcctgaccattcgcgaagcaatttgtagatttcagaaaaccgtctctgccgaagcaaggaatcgatcactgacacttctccgctaaaaatgaaatccccgccctcacctgtaaggacagacgaggcaccatactcctcagcgatcactgtaaaagtctcattaaccagtgaattggctctcggatcaggaccgtctacaaaccaaagcggatcacgcccaatttccgcgtttggaattttggctgtagcgtctccaagaatgatcaggccggggatatccatatctcgcatcatattctttacaaggtccctgtcgtggcttaatatcatgtcgggttcggcaaatgatatattgacggccagcagctgttccttgcgtccgcctgcaactgcggcggcggttacggcagctgaatccagtccgccgcttaattcgacaatatgcctttcatcctttaaacgatctgctgtcacttcctgaaaaagctcccggaacctcggaacagcgtctccagcaagatctttctcgtttaatagctgcggaagcccccaatagctgtgcacgtgaaccgcttgatcccggccgagaaaagcgtaggacgccgcaggcactttgcgtattcctttaaaaaacgtccgatcttcaaagccgttttctcctacagcaaagcccgaagtaggaaacattctgcacacatcttgatcgatcgcaaaaggaatgtcatgaacaagcaaaaggatgcgcatgtcattcgctgcataccattctcctttcggactgacccagtagtaaaccggacgggttgcgtatgtatcagtcgccaaaacaaggctatgcagactgtcatcccaccagaccatcgtatattcgccatgcgagtgagacagcatggcagctttgtcctgcttcaatgatgcgtacagcttgtcatattgctcgatctttcgggtgccatccgattttgcgttaagaccgccgctgatccagccgtctaagatgacggggtgcaaaagatttatttgagttgaaggtctaaaagcttcatcgtatcggatatgcgcttcagccatgtttgcgatcccgcagctgtagctatgaatccgttccgcccgtccccatttcttgacggcggaaacccactcttgccataaagcggtgttgtttccctgcattccaaaccatattttcatactagagataacacccacctttcagcgtaagcgctcatcttatatgtctgtaaaacttttaaattcttatttttatgattcggatcgatcgatttgccgttttccatttgaacccacgcgtgagaaaacagcttgtcatcaattttcttgaccccgatcatgagatcagcatcagacccattgctgaataatatagattgaatcgttaatgcaatagaaacgcatgaagtgaccaaatggtcgtcttcatcaagggaatacaaatattcgccgttccggtgcagttcgtctatatcaagaagccctgcacctctttgctttgcgctcgcatacagcggaaacaggtggatcgcaattttttcataagcttcttcaaagtcataatttaacagcatcatacgtacaaaagcatgaacggttgtaaaatattcgtggtttttgacaagcgctctttttttcatcagcttttatcctctattttaatgagcttatgatgtgtcagttcctgtatcgcctcatttaatatcgctgatagttcttcttccgtctgatcgaacgccgattgccacttgatcagaatatcttttttatcctttcgctcattttcaatttcgatccacagctcttttaaagccccttccaatccgaaatactgcccattgtccaggtttaggacgatgcattcattttccaacacggttgtcgctgtctcttgatttcgaataattttcaaagattagacctccccggtatgcatgatttcagaaaaataaaggagaagagagccggcaagctctctttcagcactttatgcatgatgttctttccacgccctcgttatcatttcagcgctggagcgttttaaaaagagcctgcaatgcgacgatgcccctgaatttaccaactgatcacatgaatcagattatcacaggacaatattaaaaaaaccgcaaaaaactaccgaaaaccgacatgattagccaatggcatcaatgggccattattacgggatttattcggaggaaaaagaaaaagagagcctatcgactctcttttgcagggaaaaacgaatatatactttgtctatactttctgcttgatcaaattaagcatcgtccctttttttactgcgcagtaccgcgacgttactttgagctttttatagattttgctcaagtgatactctacgttccgcgtcgacatttgcaggtctgctgcgatctctttatttgttttaccgctggccaccttctgcaaaatatccagttctgtgtctgttaaatgctcgtccaccgagagatcggagtcgagcctcagtttttgcagcaagccgtcgggaaataacacagccccttttaaacacaataaaatactcgaagctatcatgctgtctgtatacgatttatctataaaccctttaactccggcctcgatcaacttattaaaatatgagtgaatttcatctcccgaaaacataatgataattttggattgaggttcgatttccagcgttttaagagacagttccaacccgttcatccccggcatttttaaatcataaagaaaaacgtctatatgtacctcttggttttttaagaggtcgagagcttcatttccttcgtggcaaacgatgacatccatattatatttttttaatatttccttcattccggatgtcagaaccctgtagtcgtctactaacaacacgcgtatcatcagtaacactctccttaaatcagtttcctccgaacaaataccgcaataaaaaccccatgaatagaattgaaggatgatgtcgggttttagtgcctttttgtggtttttaccactatattctatgatagcatgattatgtaatcaactggaagtaataaggaggtgacacagatgcgcaaattggaaagtgctcaagttaaaagctatggttcattcctgactgttactctttctaaaaagagcaagccgggcgacggcaaattcggccgcggcgtaaaacgcggttaagagtgtatgaaaaagagtgcggatagttgaaatccgcactcttttgccaatcaattaatgtccgctgtgctcagaatgttttgcacctggagaaccgccctcagggttgtctccgtgatagttgtgagcagcgaagatccagacggaaccggcaataatcgcaaccgcaataaacgcggcaaacagcgtattcccgacttggattttgccgctgtcactctcagtcatatgcataaacattaagagctgaagtccagcttgaatgatcgcaaaaccgaaaataatccacagctttgcagccatgcttaaatccgtatagatcacccacaaggccaataaggtcagcacaatggacaacacgaacccgacaatatgcttccaaggaaagtggctgtgttcagccgattgttttgctgccattatacattcaccaaccctatcaaatagacaccggtaaagatgaagatccataccacgtctaagaagtgccaatacaaacttgagataaacagcttagcagacgtttgcggggtgaggccgcgctttttcgtctgaagcaatatgccgataatccagaagataccaatcgatacgtgcagtccgtgggttcccaatagaacaaagaatgctgaccagtaagcacttgtcgataaagtggcaccttcgtgtacataatgattgaactcataaagctcatagctgacaaagccagcaccgagcaacagggtaatgatcatccagatcatcacgcctttcaaactgccgcggcgcatttcatgcactgcaatgccgcatgtgaaactgctcgttaacagcaggaacgtcatgattaaaacgagcttcgcgtcgaacagttctgccggcagtacgcctcccgctgttctgttatgaagaacagcataggtcgcaaataacgtagagaataaagcaatctccgctccaagaaaaatccaaaagccaaggatattcaaccttccgatttcagaacggtattccataggagcgttagaattgctgtgttctgcatgttccatcaatcccgcctcctttacttggcattctttcgttcagtctcttttatttcctcaacacttacatagtagccgtcgtcatattcatatgaacgaagaatcatacagaggaatacaccgatcagaccgacgattcccatccagaaccattcaaagacaagcccgaatccagcaaatccgaagcataatgacatgataaacggacggcctgaattgctcggcatatgaatctttttaaacttgctttcaggatgaatctcgacattgtcttccttcatttgcgcaaatgcgtcaggtgaagtgacctcaggcagaaccgcaaagttatagtgcggcgggatcgcagaagatgtagcccattcaagcgtgcgacccattccccaagcatctcctgattcctcgcgttttgaatgacggaagctgtagaaaatgttatagcagagaacgatgaatcctgcggccatcagcaatgcgccgaatgtcgcaatcatgttcaatgcagtccagccgtcttctgctccgtatgtgtaaatacggcgaggcattccctgcaatccaaggaaatacatcgggaagaaacagatgttaaagcccgtcatgaacagccagaagaaccattttccgatgcgttcgttcagtttgtgaccgaacattttcggataccagaagatcaatccggcgaaacatgcaaacacagtacccgcgatcagcacgtagtggaagtgcgatacgaggaagtatgtgttgtgatattgataatccgcagctgccatcgcaagcataacgcccgtaacaccgccgatgacgaagttcggaataaatgcaagcgaccacagcatcggcgttgtgattttaattctgcctcgatgcagcgtcaacagccagttaaagattttaaccccggtcggcaccgatatcgccattgtcgtaatcgagaagaacgagttgaccgccgcgctgttgcccattgtgaaaaagtggtgcagccaaacgataaagctgagaaccgaaatcgccacaatggaataaaccatcgctttatagccgaacagctgctttctcgcaaatgttgcaatgatttctgaaaaaataccgaaagcaggcaaaataacgatgtaaacctcaggatgtccccaaatccagaacaggttcgcccatagcatcggcataccgccgtttgccaaagtgaaaaaggctgttccgaacaagcggtcaaatgtcatcagcgccaaagccactgtcaagacagggaaggcgaaaatgataatcacacaagtgatcagcgttgtccaagtgaacatcggcatccgccatagagtcatgccttttgtacgcattttcaggatggtaaccataaagttgatcccggtgagaagcgtaccgatacccgcgatctgaagtccgagcaagtaatagttctgtccaggtccaggactcagctcgttgcctgcaagcggcatgtaagccgtccatcctgcattcggcgatccgccgatgacgaatgaaatgttaaacagcatcgctccgaccatgaaggtccagaagctcaagttgttcaagtaaggataagcaacgtcccgcgcaccgatttgaagcggtacgaccacgttcattaacccaataagaaacggcatcgccatgaagatgatcatgatcgtaccgtgagtcgtaaatacttcattatagtggttggaatctaaaaagccgttattaggaagcgtgagctgggcacgcatcattaacccgtcgacaccgccgcggaagaacataatgactgcggcaatgatgtacatgattcctaaacgtttatgatcgacggtggtaatccactctctccaaagccatttccattttttgaagtatgtcagcacaaatacgattgcaattgaagtaagcaaaatggaaatctgtgctccaagaattaatgggtcacctgtaattatgaattcgtcccatttcaaattcatgcaagcttcctcctttcctagtgagaatcttggtcttcagattgtttttgatctttgtttgtctttacgttttcaaacggatctgatttagagtgcggagacaacggtttatagcccagtctttcgcgcgctttaatggcgtattccgcatcatttccgtgattaacgtacttcaggtgtgtagatgagaacgtcatttcgtccgcatgctgaggaagcatcagttcatcgtactgggttttcgtcagcttgggagcttctttctgcgttttcttcacccagtcattaaacttgctttcagataccgcattgacattaaacttttgttctgcaaaaccttcgcctgtgaagtttgcatttcggcctttataagtaccctcatggtctgcctgtaaatattgctccatttccattccggacatggcgtatttttgcccgccaagctgcggaatccacagagatgccatagagtcggcagatgagattttaaacaagatcggtctgtctgtcgggatattcaaatagttgaccgtttcgatatcctgttccggatagctgaatacccatttccaatcgacagatgtagcatatacgaccaaaggttccttgtcctttgatgcttttggagcctcttctagagaataaattgtttgaactgtcggcactgacagcgcaataacaattaaaatcggaaccactgtccagacgatttctaaaaatgtattgccttctacttccgggctgtaaggagactttctgtctttacgctcacggtatttcacaatcatcacagtaaaaaggacaaatacgaccgctacgataaacagcataaatccaatcgataatagaataagatctctttgctgcgaagcaaccggtcctttaggatccaataccgcgatttgactgcagccgcccaataaaaaaacggaggaaagcagagtcagcataatcagtggtttaaatgctctgaacaagaggatcaccatccttccttaatgatgtctaaaatttggtcagaatatctaagataaaaggattctgaaaaacttttttcttctaccttgctatgctatcaaaatcttcaccaattagccttatttttttcgattgttcacctttttttcacccaaatgtcacaaaatcgtcaaaatttgttcatgatattatgaataacaaaggaaaaagactggtaattttttagttctttttacacacatagcaagcgctgacaaatccctccggaacaaaaaatctgtcaaatttaggtttaccacaataaaaaactttggtcaatcattaatttcacattgttaaattttttcatggtgaatcattatccttctcccttccttttccctgctgacaaccggttttaaactaaagaacatcaaaaaagagctttcttctgtgactgaaagctcttttttatcctatataataggcgttatcgcattctagctttgatagccgttcggatgtgctttaaaccacttccacgcgctgtcaatgatcgtttccagttcggcgtacttcggctgccatccaagctctttcaccgctttttccgaagaggcgatcagctgtgccgggtctcctgcgcggcgctctgcaacctccgccggtatcggacagcctgtcactttccgggcagtttcaacgacttctttgactgagaagcccgttccgtttccgagattgtatacggcgctttctccgccgtttcgaagcctctcgacagcgagaatatgcgcgtcgaccagatccatcacatggatgtagtctctgatgcacgtgccatccggagtcggatagtcgtcgccgaaaatcataatcttgtcccgtttgcctagcgcgacttgaagaatgatcggaatcaggtgcgtttcaggctggtggtcctcgccgatcaagccgtctacatgcgccccggcaacattaaagtagcgaaggacgacatgacggattccgtatgccttttcagaccacttcagcattttttcaatggcaagcttcgtttccccgtacgggtttgtcggatccgtcggatctgtttccataatcggcacccgatccggttctccgtatgttgcagcggttgatgagaaaacaatttgcttcacatcgaactctttcatgacctttaacaggcaaacagctccgtaaacgttgttgtcataatatttgagaggatctgttacgctttctccaaccaatgaatcggccgcgaaatgcatgacagcctcaatgtcgttttcctgaaacacctttcttagaaatgcttcatcgcgcagatctccattatagaaagaagctccctttaaagccgcctcttcatgtccagtttgcaggttatcaataattacgacatcttcattgcggcttaacagttccgctacagcatggcttccaatatagcccgcccctccgcatactaatattgccaattcatttctctcctttcagcggcgttatccttctattttaaaatctataaaacgcctgtgaatctctttttcaaacaaagatgatatatttgcttttttcattttaccaccttcagcattttccggcttgcatttttcatcatttcttcaaataaaaagttgggggaaaaacgaattgagagaccttcattccattaaataccttacaaggaatagttcgggtttttatccatatcaatggttttctcttggtgaatcaacgcgattttgaggcaaaagctatacttttttcactgcatttgaaaccaatgttctttttttccacttaatgctgatcgataatagtattttcgtattacccttctttaacccatacagcaactaagcccaaagaaccctctccacccattagatctttaatctaaataaccccttcaaaccatcgattttccaatatttccacacaatgacctctcaaaaatcccttccttgtttttagaatattcaaaggatattcggctgcaattgagaaattcttaatagggaaaaatgatcatttttatttgaatactatccagtcagtaattgattgtttattattataagtaagaatctaagattttttggtttttttagtcagttatttagggaataggtaggtttatcaatgatgactttgtgaattttttatgaaatttgtcattgttttcacatggctgttgttttataacttttattgcatctcaaggaagaaccgttttttctttgaggtgaacaacgtcttatcatattggaggaagctatgaatactcaaacgaaacacaagttggacaaagattgggtgattttgatgaaggaggcgaaaaaacttgggctgcaaattgaagatgtgaaagaatttcttcgcagtcagcccatccaaagcgatgctgaaaaacagataaagcaataagcgtttaaaagcatcagttatccaaaaaaacaggcggttctgttgaatcttggtctatcaagatgatccaaccggctgttttaacgagtgttttaattgataatgacgtatttgagcagcaggcttgctgcctgtgtatagattctgtctgctccatagaaacgagcattttaaggagcagccttaccttttgccctgtacataggttgtttcactttttccagcttcactctcttaaggggtaccagaccggattgattaaggcgttttagaggcattgctgaccaacgctgatgccagcagccccatacactttcttctgtatcggtttcgattgcctttctcctgaaagggggcggagcttttggccttaatccttttgataccatcctcgggcttcctttccatactcccttttctgttaaccatccgcctatataatcggttttttcgatgttaaatatctaaaatatcaattttactgatggttgttgttatcttaaactgaattcatgacccattccagaggaggatgatgaatatggggatagcagcaatctgcggaagctcccgcgaaaacggaaatacggaagagttggtgaatcgattaggtagacggacttgatgccgataagatctacctgcgaaactatcacattgagcccgtatcggactacaggcacggcaatacagcccctttgtatcctgatgatgactacagagacctgatcagccgggtgctggagaaggatatcctgatttttgccactccgatctattagtacggaatgtcgggtttgatgaaaaactttattgaccgctggtcacagacattgattgagcacgggagatctgcatttaaacagcaaatggcgaaaaaaacggtctacgtcgcggctgtcggagacgatgatccccgcttgaaagggctgccgcttattcaacagtttcaatatatctttgattttatgaacatgacattcgacggctatttgctcggcaaagggaacaagcccggcggcgtggtgacagaccggacagcgattgtgtctgcaaatgaactgagaaggaagctggcagaggcggaaacggggcaaaagcatggcaaataaaaaggcgaacaaacggttttatttatggaaaaagcatttattcgagatgatcaggtctttcatcttatataaataaaaggctttgtgaaaattgaagaataaatccggagcttgttacatacctttgttgtatcttttcagacaaacacaaggagggtcaaagaacaaatgggagaaggcaaaatagattacagcaaagctgcggcatctccggagttccagcggttgttaaagcggaaacgggcttttattgtaccgatgacgattttctttttgctcttttatttcctgctgccggttatgacatcatacttcacatttttgaatcagccggcagtcggggccatcacgtgggcatgggttttcgcgattgctcagtttgttatgacgtggacgctgtgcattgtgtatacgaaaaaagccggtcaattcgatcaaattgcaagcgatttcaaaaagaagattggaggcgttgattcatgagtgccacagcctttattttgtttcttgccattgtcgccctcacgcttgtcattacgtatttcgccgctaaacagacaaaaacggccaatgagttttacacggcgggagggggacttaccggcattcaaaacggactggctattgcgggagattacatgtcagcggcttctttcctcggaattgccgggatgatcgctttgaacgggtttgacggtttcttctacagcatcggcttcctcgtcgcttatttagttgtcctttatattgtggcagaaccgctccgaaacctcggcaaatttacaatggcggacatgattgcctctcgttttaaacaaaagaaaattcgcggtgtcgccgcattaaacacaatcacgatctccaccttttatatgattgcacagttagtcggcgccggcgcgctgatcaagcttctgctcggcatcgattatacgctggcagtgtgcattgtcggggttttgatgaccatctacgtcgtattcggaggaatgattgcaaccagctgggtccagatcatcaaggccgttcttttgatggcggggacgctcatcatttcggtcatcgttttttcaaaattcggcttcagcctgacgaacatgttcgaacaaatgaaaacagctactccgctcggggcggattttctaaaccccggcaataagtataaagttcctcttgaaacactttcactcaatttggcgctcgtccttggaacagccggcctgccccacattctcatccgcttttatacagtaaaagatgccaaaacggcaaggaaatcggttgtctcggcaacatggattatcggtatattttatattatgacggtctttctcggttttggtgctgccgcttttgtcggttttgaaaacattttagctgccgataaagcggggaatatggccgcaccgctgcttgctcaggcgctcggcggagattttctgttcgccttcgtctcagccatcgctttcgccacgattttggcggtagttacaggacttgtcctgtcggcggcttctgcttttgcgcatgatatatacagccagattatcagaaaaggcgcggctacggaaaaagagcaaatgattgctgcaaggtgggcttccatcggcgtatccgtcctttcaattctgcttgctgtctttgcccaatcgctgaatgtcgcgtttcttgtctcgcttgcatttgccgtggcggcaagcgccaatttgccgctcattatcttcaccgtcttctggaaaagattcaatgccgccggcgctttggccggcagcctgaccggccttttaagcgctctgatccttgtctccatcagcccgagcgtatgggacccggccggaaacgccatctttgttggagacccgctcatcccgctttccaacccgggaatcatctctattccgctcggctttttaggcgcttatcttggaacgattctatcttcaaaaacccctggtcaagacgcgtttgcagaaattcaggtcaaagcgcatacaggcatccacatggatcaatcttaaaccgtgtgcagccgaaaaaaacttatgagccggccggcccataagtttttatttattcccgaaagcttgccagccgctcgttcagcgttttcgtgtgccggtagacatctctgtaaatttgaaagagagcttcgtattgtctgctgtattcacggcggggcgaaaaggtttctttgatgagaacgaatcggtctgcacaagcctcaagcgacggaaaccagccgcacccgacggccgcaatcatggctgcaccgtatgccggcccctgttcgcttgtcagtctgatgatgtcggcgttgaagatatccgcctggatttgcagccattgattgcttttggcgcctcctccgattgaaatcacacggctgatgtcttttcccccggcacggaattgttcaatgctttcatgaagggagaatgtaatgccttcaataacggctctgacaaagtccgcccgtgtatgtgcgctgtccatcccgatgaagctggcgcgaatatctgcgtcggcatgaggagttctctcccctgacaagtaaggggtaaacagcagtcccccggccccgggacgggaatggccaatatcgctgattaattcgtcaaatgacgcctgcccggcaaatacatctttaaaccagctgaagctgcgtcctgcagaaagcgtcactcccatcgaataaaacgcatctggggctgcatggttcagaaaatgaatattgccattaaactcttgatcacggtttgattcatatgtgagaacaacccccgaggtgcctatgctgcaaagggcgggttccttcttttaaaataccggcgccgacagcgccgcatgcattatcagcgccgccggcaaacaccttgacttcaggagacagcccggtttcggccgcgaattccggtctgaggccgccgacacaagcgcccggttcaatcaaatccggacataaggactccgggatgccgagctttctgcagatttccccgctccatgtttgatgtctcacatctagcaggagcgttccggccgcatctgaatattcgctgtgaagacgccccgtcatggtgtacctgacatagtctttcggcagcaaaaaaacggccgccttttcaaacagctctttttcatattctttcacccataaaagcttcggaagggtaaaaccttcgagcgccggatttttcgcgatctcgagcaggcgctcctttccgattttgtcgttaatcagccggcattgttcggttgtccgtgtatcgttccacaggatcgcgtttcgcaaaacctctcctttgccgtttaaaagtaccaatccatgcatctgtccggaaaagctgacccctttaatctgagatgcttttcccgggaaatgcccgaccaattccttaatggcttccttcgttttgtccgcccattctgcgggatcctgttcggaataaccggaatggggctcaatgatggaaaacggtttggagacctcgccgcacagctctccccgctgattgacaaggatgattttaaccgcgctggtgccgagatcgaccccgattacgtattccactagcgtgtctcctttcctgccggcgcttcgcgcaaagcgttcaataagtaacggttaacggtcgccttcagccgttcttggcggcctgactgattttcaatatggtcgttttcaagagcgtaagcggcgagctttttcagatcggtgcggccttctttgatttcaagcccgatgcctttcgtatagctctcataacgttcttcgataacctgatcgagcgctttatcttcaagcagacgggaggcgactttcaagccgactgcatacgtatccattcctgcgatatgagcgtgaaacaagtcctcatcggcaaatgacgggcgccttactttagcatcgaagttgatgccgccggttttaaacccgcctgctttcaaaatttcatacatcgccagaaccgcagaatacagatcggtcggaaactcatcggtatcccagcccaagagcaaatcgccctggttggcatcaatggaacccagcatatcgtgcaaggcagccacccttagttcatgctcaaatgtatgcccggccaatgtcgcatggttcgcctcaagattaagtttaaaatggtcttttaaaccgtaagtttctaaaaaagcgatcgttgtggctgcatcaaaatcgtattggtgcttcgtcggctccttcggcttcggctcgattaaaaattggccgtcaaaaccgatttcacgcgcatactcaactgccattctataaaatgaagccaagttttcgagctcaagcttcatatctgtattcagcaatgtttcataaccttctcttccgccccagaacacatagttttccgctccaagctctttggcgatgtccaggccttttttcacttttgcagctgcataggcatagacgtctgcattgcaagaagttgcggccccgtggacatatctcggatgcgtaaacatattggctgtattccaaagcagctgaacatggcttgtctccatcatttctttgagaaaagacgacatttgatccaaatacgtgaaagtttcacgcaatgttgctccttcatcgacaatatcaacatcatgaaaacagaaatagggcacgccgagcttttcaaaaaattcaaaagccgcttccgccctggctttcgctttatccaaaggatgtgtcagccggttccacgcccggaacatcgtcccgtcgccgaaagggtctttcccgtccgcatcaaaggtatgccaatacgcaacagcgaagcgaaggtgttccttcatcgttttgccgccgacaaattcatcagggttgtaatatttaaatgcgtaaggattttccgaatcggccccttcatactcaatcattccgatatttctaaaaaacattccgatctcccccttcacttttccttgcaaacgttaaaaaacaatgtttgtttaaccattaaactaacttccttgtatgtattttacaggatcaattaatcgctttcaatggaaatagaggaaaaaataagttttcaaaatttgttatactataataaattcacagcttcaaagcaatggagtgattgacattgaatacagcggatcaagcccttgtaaaaaaaatgaacaaagccctgatttttgagcagattattgaaaacggacccgtctcaagggccaaactttcggaaataacaggattaaataaagcgaccgtttcctcccaagtgtcttccctgcttcaaaaggacatcatttatgaaacgggccccggcgagtcaagcggcggcagaaggcccgttatgctgaaattcaatcgaaaagccggctatgcggtcggtgtagatgtcggaaccaattatataattgttgcgttaaccgaccttgaagggcatttgattgaacaattcgaacgaacgcttgatgaagaagacattcaggcgacagaagaggcattaatcgaattgacggggcttgccgttgacaaaataccgccttccccattcggattgaccggaatcggcgtgtgcgtgcccggcttggtggacaacgaacggcatgtagtctttacgccaaataagccgatccatttgattccgataaaagaaaaactggaagaaaggttcggcgttcccattttaattgaaaacgaagccaacgccggcgccgttggcgagaaggaatacggggaaggcggccagcttgagcatgccgtgtttgtcagcattaataccgggatcggtttagggattttaatgaatggaaaattgtttagaggtgtgcaaggtttttccggagaagccgggcacatgtccattcactttgacggtccgttatgccggtgcggaaatagaggctgctgggagctttacgcttcagaaaaagccgtcttctctcactatgcagcgaattccggggcccagctttacgaaaccgttaaagaacttgcagaccgcggtgatccgggcatgatggagacgtttgaacgctttggctttcatatcggcatcgggcttctcaacatcttgaaaacgttgaatcccgacaccattatcttgcggaataccatagtggaatcctatccgagcatcgtcgatgcgatcaaaaaaacgattgcctcaagaagcgcagcagaagccttgtctaattatcatttaaaaatctccacgctcggccgcaccgcctcagcgcttgggatgtcctcccttgtaaccgaacgttttctggaacggtttatgaacgagagattttaatcttcatataaaaaagcgcatattccatttaggaatgtgcgttttgcagattttatcatcctttcagcgtgattgaaaacccttgcagtctaggaaggtcgagcatcggagcggagcgaatgttggaattcgtgagcaccgacgcgcaggcctgacaacgaatgcgagggtttctcgacacgctgaaaagcgcatattccatttaggaatgtgcgctttgtttggcagcttggactttctcgctaaacgcctcggcggcctgctttggatcggcggctttgctgatggcgctgatgacactgatgccgtccgccccggcctcgatgacggggacgcagttttcgaccgtgatcccgccgattccgaccacaggaatgccaattccctgcctgcggatctcttgaatgagcgagacgccctgcacagcttttgtatcccgctttgtttcagtagggtaaacaggccccgcaccgatgtaatccgctccatccttttccgcctttaagacttcttcaagtgtatgcgcggaaacgccgaggattttgtccccgattctcgctctgacgtctgcggccttatcatcatcctggccgatatgcacgccatctgcgtcaagttcaagcgcgagttctacatcatcgttgataataaacggtacattgaactgtttgcacagcgcctgcacctgtcgggcaaacgccgtttgatctccggctttcaacgcaccctcgcctttttcgcggaattgaaaaagggtcgcaccgccttttaaagctttttcaataacagttaaaggatcccctgcggtattgtttgaccccataataaaatagaccgacaacagatctttcattgcttcttctgagactcgcgtcatcttattccacctctctgatcctgccgcgttcttttatatccatagcttcaacggcagcaagctgattcaaaaactcgatttggaaacttccgggcccccggctttccgttttcgccgcggccaactcggccgctgttccataaaaagcggctgcagatacagcggcacggcaaacgtctttttcaacggcgcaaaacgcaccgatgacagaggtaaacaagcagcctgtccccgtcactttcgtaagcagctgatgtccgttgcccacggtatacgtttttgtaccatccgttatcacgtcttcagcaccggttatgatgactgctgtatcccataatttcgcggctttttttgcgagctccgttctgtcgccgctctcttcacccgcgtccacgcctttgatcagccagtcttccccaagcgtgttggcaatttccgcagcattgcctctgacggcagaaaccttcactttgcgcatgatcgcttgagccgattccgttcgaaacggcgtcgcccccgcaccgaccggatcaaaaataaccggcaccccatgttcattagctgactttcctgcaataatcatcgcttcaacagattcacggctgagcgtgccgatgttcagcacaagggctccggcgatctttgccatgtcggcggcctcttccctcgcatacgccatcaccggcgatgcgccgagagccagcaaaccgtttgccgtaaagttggtgacgacattgtttgtcatattgtgtacgagcggtttttgctttctgactaactcaattccccttgcggcatcttccatattcattcgcctgcattcctttctgtttttgaattctcgctccatatatacgattttgtatgatcaatccacgccctcgccgcgaacgacagatagcggtcttttctccaaatgacggcgacatgccaaggaatggccggcctcaccagcggaatgatcctcaccctttcagggtcaagatcccggcagatcctttcgggcaaaagacctatcccaaggttcgcggaaaccatttcgctgatgaaatcccattgtgaggtttcataaatgacattcggctgaaatcccgccttcaagcaggccgtaatgatccgttcgtgaagaacaaagtcttcccggaagaaaataaacggttcttcgcttaactgccgaagctcgatctcttccgcatcggcaaaacgatgggacgggtggacgattagcattaagtcttctttaacaattgtaaaggagtgaaaaatctcctcttttgcaggcaggacgacaacgccgatatcaagcgatccgtcctctactccctcctgcactttcacagacccgtgttcaacaagctgaaaggtgacgttcggatacttatctctgaaatcccctatcactttcggaaaaaaaccggagccgatcatcggcggcagaccgatcctcacatgcccttttttgacgtccatcaagtcgttcagctcagaagttaaattttgaaatgacttggtgatttcctgggcctgcacatacatgctttgccccgcatcagtcagctcgatctgccggccgcgccggtaaaacagctcgatgcccagctcttcttcaaggtttttaatcattttggaaatcgtcggctgagatatgtataatgactgagcggcttttgtgaagcttttcagacgggctacctccaagaaataggttaagtggcgtatgtccatttgtttgacaccctttcagagttcctgcgtgtattcatattctaaaccaaattcattgttttctgcacccccgcgagagccacaataaaaaaaacgccgccggcatacagccggcagcgcctatcttcgggcaatcgcctcatcctgttccttcagcgtgtccacatttgagcgggtgtcctcaatgtttttacgaacagcctctttatactgtttgaccatattgcaaatttcggcttctcgttcaagccactttttcgtaaaatcaaggttgttccgcccgagcgctccggctggcgggctttttaaagatacggcttgaagcgtgctgcttacttgttccagcttcttcataaccgctgcatggttaagtttaatcgttttgctcatttcaaccatccttttaaaccgttgattgtgctgtgcagagcgtcgacggcttcctctcctttttccatcagaaagtccgcccggtcggctgaccagcttgcagcctgaacagctcctttttcagcatctaaagcaaatatctttaaatcgattttatgaatataccgatcatactcatcggtgaaaattctgtacattgccgtgtgcgcttcatcacgtgcttcgtcaaaatcggctgccctgcttccggtccacgactcattaagattcggccgcaaaatctgcctgatttcttcgattccgaggttttgttcccgctctacatcgcgctttgcccgctccagccttgcaatttgttcttccagctctgccgccttatgggagaggacaccgtgtattttttgcagcgtgtctgagtagtccattattgtcacctctgaaattgcagtatgattcgcattgattatttccttgtcaaatcatgatccggtttgtttttcatagattcacatctttgactagacttgctctcatttccaatatttatagtttaagtcgaaaatcacggatgttgaataggctttaaagactgtttttagggatatatacacagttcgccatcatcctcacaccgcatttcaaggacatataacccgtctttttgaatcatctgtacaccgctttcattgcggacaagtctaaaggcacgggaacacggcggtttaatggtcacaaaaaatcgccaaatgattccgtatgacgttttccaattttagttattaaactgttgcttttgacctgatttgcgcttttaactatagacaaaatgaataatatatattctgtatatgtattttacctatacttgaaactcatgtacactcttgtttagaaagggggataatgacatgaaaacattcattaaaggattaggtcaggtcgctcttttgtttttattcgcccgtttcatgaatctgattgtcgaggttcttcatataaacattcccggcagcattctcgggattatcgtcatttttgcgcttctccatttcaaaatcattaagctggaatggattgaaatcggcgcgctgtggcttctcgcggagctgcttttgttcttcgtcccttcagccgtcgggattatgaactacggagatattctggctgaattcggcacaagcattatactcgttgtcctcatcagtacattcgtcgtcatggtgtcgaccggaatgctgactcaattgattgccaaaagaaaggaaagaaaaaaaacatgctcatcggatgcttaagcctgatcgcaacagttttaatctatttgggcgcaaaagcggtgtattcacgccatccaaaggtgtatgcgtcacctttattggtcacgccggtgatactggtcggcctgctgcttttcatcaacgtcccttttgaagcgtacaatgcgggcggacgcttgttgacggacatgctccagccggcaaccgtggcttttgcgattccgctgtacaaatactttccagtcttgaaaaaatacgcggttgagatcattatcaacgtggctgtaggctgctgtatcgcgatcctgtcaacagcgtttatcgcaaaactcttcaagctgaatgaagacctgatcgagagcctcgttcccagatctgtcacaacgccaattgcaatgaacgtttctgaaatgatcggcggaatgccggcggtgaccgctgtttttgtcatattgaccgccttgttcggatcagtgatcggaccgatggtcattcgctacttccggattgataatgaaatcgcgaggggcgtactgcttggcacaagcgcccacggcgcaggtacgtcaaaagcatttgagctgagctccgtgtccggaacgatctcaagcgtgtcgatgatcctggccgcgatcatcacgctttgcgcagcgccgtttctgatttcccttattgcagtgtaatagccgaaaaaaaaaccaaattggtgaaggtttttccgccaatttggttttttcatttagaaatcgatcagccatatgaatatagacatcatcaataatacaacggccagaataaaagaaatacacctaaaagacctgtcatgcagcagttttggggaaattgcttttaacagtttgacgttcagtaaaccgatcaaaccgaaaagtgtgaagactcccgatccatccgccgccatttccgagaaaaatccatcgcctttttctttggaaaatgcccacaggaatcctgcgaaagcccctgtgagaaaagcggtcgtcaacaatactttgacaaaggccatcactagattctcaacctttcagctgttcaaccgcagtctcaaattccttttcaatctctgcccgcggcttctttgtcatcaggctgacggcgatgatcacgactgtacaaacaataaatccgggaatgatttcataaaccgggtcaaacgctttcacttgctcccacacaataacggtcagcgctccggacagcatccctgcaagcgcgccccacttcgtcattcgtttccaatacaggctcagcaaaacgacagggccaaatgccgccccgaagcctgcccatgcatagccgacaagattcagaatcgtttcattcggatgaagcgccatcaagagtgcgatcagtgaaatggcgaggacagacagccttccgacaagtacaagttctttatcagaagcccctttccggataaacgctttataaaaatcctctgtcagcgcgcttgaggttacaagaagctgtgaagaaattgtgctcatcaccgctgctaatatggcggccagcaagaaccccgtaatcattgaagggaacaaaaggtcggcaagcttaatgaatatcgtctcggcattctttaacgtaagatgattcgcactgaaataggcaatgccgacgagtcctgtcagcatcgctccgcaaatcgaaaagatcatccagcccatgccgattcttctggcactcttcaattctttcacgcttgaaatcgccataaacctgacaataatatgaggctgtccaaagtagccgagaccccatgccagtaaagatatgataccgattacggttgttccttgaaacggacggaggagatccgggttaaccgcgttcacttccgaaaacgccggcgcaattccccccagttgaacaaacacgactaccggcattaagatgagcgcgataaacatgatcgtcccttgaacaaaatcggtccagctgacagccaaaaagcctccgaagagcgtataaagaatgacaaccccggccgtcagccagatgccgatccgataatccaggtggaatgcggttctgaacagctctccgcccgccaccattccggatgatgtataaaaagtgaaaaatactaaaataacaaaagccgacgtcatccgtaacagtcttgaaccgtctttaaaacggttttcgaaataatcgggtatagtaatgctgttgccggccgtttccgtatacgtccttagcctcggcgcgacatacacccagttcaaataagcgccgattgtcagaccgacaacgatccagccgctgctcaatccgttcaggaacatcgcaccgggcagccccattaatagccagccgctcatatcggaagctcctgcgcttaacgcggtaacggcgggacccagatttcttccgccaagcatgtaatcggtcaaatttgatgtcctgcgatatgcaaaatatccgatgaaaagcattcccgccatataaatacctatcgatattaaaattccgtaattcatagcttccccctgcctgtgtgatttgcgtaatatcaatatacatgaataattgaccgacaggtattgtttttatcgcaaattttttctccagccttacattaacgatggcgaacctgtaaaaagacaacttttaaataatcgccctcaggatagcttttcaccgttttaaaatcttcgggaagcgaatgctcctcaagcactgtaaagcgcgtccccgtttctttgcatgcctcttcgataaagcctttgaattttttcattccaaatgcgctgctgttcgtcgaagcgacgatcacaccttgatctttagtgattcgaatcgcgtcttttaacagatttttgtaatcctttgccgcgctgaatgtatgctttttcgttctcgcaaatgaagggggatcaaggatgacaaggtcaaaggcgagttcttttttggccgcgtattgaaaatatttaaaaacgtccatgactttaatctcatgagcttcatagtccagcccgttcacactgaattgttcgatcgtcctgcttaagctgcggtttgcaacatcaacgctcgtcgttttttcagcgcctccgagcgccgccgccacagaaaatgcgccggtatatgagaatgtgttgagcgcggttttcccttccgcataccggtccctaaccgccttgcggacatggcgctgatcgagaaaaacgccggtcatcgctccgtcattgaggtaaacggcaaaatgaatgccgttctctttcacaatgatcggaaagtctcctctttcgcctttgacaaagtcgtcatcttccacatactgcccggccgtattaaaccgttttttctcataaacagctttataatccgtcaattcatcaagggcttccataatcgtttctttaagcgtataaatccctttgctgtaccattggaacaaatagtagccgtcataatagtcaatcgtaaagccgccgattccgtcgccttccccgttaaacaaacgaaaagcggtcgtatccgggtcttgaaaaagcgattttctggcttgaaatgctttcgccagcctgcttaaaaagaatgactggtcaatcgattccccctcgtttcgagtcagaatccagccgatccctttgttttgctcgccataatagccctttcctaaaaacctgccgttttcatcggttatcctgatcagcgatccttcttttatgccgttttcttgcgaagaaacggcctctttttcgattaggggatagccctttttcatttttgcagcgaatggatgttttatttttaatgtatgcattttaattcagtccttatcttaaagtcttctctatcctaccataacgcctgatagatgttcttattcatcatgtaatcgatataattgacagatgattccgaattttctaagatgatggagaaactaaaggaggaatggcgaaatggcgcgaatcgaccacgtaggactgatggtgaaagacattgatgcttcgatcgcattctaccagaatgtgatcggaatgacgctgaaaggcagaatgacccatacaaacggcgtcatgaaactcgcttttttaggctttgagaacagagacgagacagagctcgaactgatcgagggatataacgacaaccttcctcaggaaggaaaagttcatcattttgccgtctcgaccgatgatatcgaggctgaatttgatcgcgtaaaaggcgccggcatcaagctgatggaagatgagattaccgtattgccgaacggcttccgctatttttttctttttgggcccgaaggagaaatggtcgagttttttcaaagaacataaccggacgcggcttatcgccgtttccggtttttattgaacgcggaaagccggctgctgtttttcgataaaccttttgatgttttgatatgtcatctcttcgatgcgcctgatgctctcatacgtagcgccgccgatatgcgccgtgcaaatgacattgctgagaccggcgatccgggcagccggcggttcggtttcaaagacgtccaatgctgcgcctctgatctgtttttgctcaagcgcttgaataagcgcgctttcgtccaccacttctccgcgggcaatgttgatcaggtacgcggttttcttcatttttgccagtttttcttgattgattaaatgataggtggcaggtctcaatgatgtgctgatacatacaaagtccgatttttccaggagatcgtcaagctcggcgaaccgcacattcagccgtttggctgcattgtagtctttgtatgtgccgtacgccaaaacgttcatattaaacccggcagcccgccttgcaacctttttgccgatttccccaaaaccgataagccccagcgtttttccatcgagctcatagcccatcgccgcttgccataagcccgctttgactgccgcgtttgactgcgggatcgaacgggcgccagacagcagaagaccgaatgccaaatcggcgaccgccgaggcattttggccgggtgcattcgtgacgagaatccctttttcgtttgcatattccacatcaatattgtcgattcccgcgccgaatttcatgatataccggagtcccggagcggcgtcgatcagctcccggtccgctttttcaacgccggcgatataaatatggacatccttgatatgagtcagtaaatcctgtctcgtcaaccgatttgaatccaaaaacgcaaattcggcgccgagccgttcgaccctttctctcaagcgcggcgcagcgcggtaaaacagtccgttgagcgtcaacagcactttaaccaaaagctctcctccattcagcaggaattttcccgaccagaaaaatgcttgtttccgaaggaaacaagcgaatatggggatacgtcagggtttgttgtcattatatcgattcatcctgcgatttaaaatgagattggcatgttagctgacatggtttttagacaatttggccggctggttaaaggctgtggactgcaaatacttaaaatattgacgggcgtacgggtgtgaggtgtttgaattccaaggcttgtttccgccgcagaaatgaacgattgccgggtttgcccttgtttccatatagcgcttttgatcgatgagggaagccggtgttttttcttttaaaataatgtgtgtttgggcgttccacctcggatgaagttcgagccactgatcataaagaatcgcgttcaatgcgtcttggtcatgaaacacaaacatgtcttcatcgttgttattgataaagtcgatgacttttttcgaaatgtcgttttttctccaagcttccatatcgatgatcattaagcccgagttaaaatattttgcttcatcgctgatgttcatctttttcagccgttcatgctggcctgcatcttcaaccgccgccgcgaaataaggtgaaatgtccatgtcccacagcttcgatatatcctctaaaactaaggcgtcgcagtcgacatagatcattcgtttaacggattcgtcatcaatcagatcgggaatggaaattcgatagtaagccgcttttgtaatatggctgctttcgaccgctttgtcatactggcttttttccacattaagaaatgtaataggagctccgaattggagggtcgtctcttccagacgctttttattctccggttcaatccctccgtcgatgacatacagtttcacctcgcgcgtctgatccatattcgtcagcaatgatgagaacatcacgcttaaatgctgtgcgtagttattgtctgtacaagaaataatatgcatggttcggtcgcttttcatatgtcgtccatctccttttctttttttgttctattcccttttttcgaaaaataaacaccgttgataggccgaaaaaaaaaggatcatgcaagatcctcagattgtatagcgtctattttgctatcttttagcaagatgctgctttaaataaaagtaaggatagccaacaatgataagcggagctgctaatgcaaggagtatccatgagcctgagtgactgcctctaatgactccaatgaaaatacaagtaccgacgagaaaatataataaagcacctaagaaccaatacatcttcattcctctttttctttacgcttgttcttggattgacgatttttgtatctatgcttgtctgttttttcgttcgcattgcttaatcgatcagggcactgattttttgacactttctcagttcggattccttttctttttaatgataaaattgtgagatcaatcgatttcaatgttgatcattcctttaatcaatagtgagttcctcattattttaaatgtaaatttggaaagataaaacgtacataaaggcagaatgcatatgtacgtttgggcaatgttcatatgttgggaagatctaatggttcactgcacattggtattgttgtgttccttctcttcctataaaatgattggataaatatatgttgcacgttcaatgaaatgggatcgattttcataagtctctttttggttaaactgttaaaggaagtggatgaggtttgctgataaggaatcctttcaaagaaaaatactactcacatgataggcgggcattaaatatgcttgcactcagagtgccgggcctggcttttattctcatgatctatgtcgcctctatcgtgctgcaatttcttaatgggagctggtccattttattgcttaatgtgtttacggtattgaccgccatctttgctttgttgcattggcactcatatcgctgggttaagaaaagggtgattctgtacttcgtattacaaggtttgatcacttttacacttgctaatgtcatgtcaggctttttagtgctgatcatcattggcctttatgcatttttgatcggacagattataggaatggcagacagaagaaagacgttcctcatcctttatttattgcttctgctgtcaatcactgtactatatcatattcacaaaggtgaatatttgcattttcttgtcatagcagtacctattatgatcgtgattatcacatatgccgctacattttttgcccaagtcgatgaaaagacaaaagcgcagctgactcttgaaaggctggagctggctcatcagcaggtagaacagctgacgctgcaaaacgagagacagcgtatggcccgggacttgcacgatacgcttgctcaggggctggtcagtttaaatatgcagctggacgctattcatgttcatctcgccaaagacaacacagagagagcaaaagaaatcgttcaacaatctatgaatagagtgaaaagcacactagctgatgcacgttcagcgattgacgatctgcgcagcaaatcagaagaaatcggttttttaaaagaaagaattacctcattaatggatcattttcaagagtcgacaggcatggcttgctttttagactacagattagaccaagtgccggacgttcgaacagctgaaaactgttattacatcattggagaatgcatagcgaatgccgtaaagcatgctgaagcagaaacgatctcagtgtccatttgggatgatgataagaggaggctccatttaaccgtcaaggataacggcaaaggatttgatgttgaaaaaggcaagaaaaagagaggacattatgggcttctcggcatagaagaacgcgtcagagcaatgaaaggccaattcaatataaagagtacaacatctaaaggaacacaaattgatatcactgtaccaattcagggagagatgccagatgaataaggttttaatcgttgatgaccatcttgtcgtgagggaaggtctgaagcttttaattgaaacgaatgatcactacatcatcataggagaggcggaaaatggcaaagcagcagttcgccttgcagatgaattaaaaccggatattattctcatggatttgtatatgccggagatgagcgggttagaagccattaaactaataaaagaaaaacacgacatccccatcattattttgactacgtataatgaagatcacttaatgatcgaaggaattgaattaggggcgaaaggatatctattgaaggatacaagttcagaaaccctttttcatacgatggacgcagcaataagaggaaacgtgctattgcagcctgatatcttaaaacgtctgcaagaaatccaattggagcggatgaagaagcagagcagtgatacgcagctgacagaaaaggaagtcatagttctaaaagcaattgctaaaggtcttaaaagcaaagcgattgcctttgatttgggcgtctctgagagaacagtaaagtctagactaacgtccatttacaataaattaggcgcgaattcaagaactgaagcagtgacgattgccatgcaaagaggcgttctgacattagactaataatatcaaattaaaatttgcccaaacgtacatgcccgaatgtacgttttttttatttcattgtccactacaatgagaaagaatgtgatcaagcaatgtgttgaaaggagattatcatgtcaaaaatgttatataaattaggaggatgggttgctcgcaatcgcataaaagtaatatgcgcatggatcgttgtgctagttgcttcgataggccttgcaatcacgttaaaaccaagtttttctgaggatatgtccatacctgacacaccttcggaaaaagcgatggatgtcattcaaaaagaatttccccacggtcctgataaagggagcatacgggttattttcggtgctgaagatggggagaaactgacttcgaagtcagcggaaaaagcaatagaaaatacgttaaaggaaatcgataaagatggttccgttgactcgattgcaagtccttttgtgacaggaacaatcgcgaaagatggcacagttgcctatgctgatatcaagtataaatcatcagcagatgatattaaagattactctatcaaacacttaaaagacagtttgaaaatggctgattatgaaggattgcaaactgaactaagcggagatgtaccaggagctgagatggagataggcggtatctctgaaattgtcggcattattttggcctttatcgttttggccattacgtttggctctttattaatagcaggtttgccgattttaacagcactgattggattaggtgtaagtattgggcttgttttgattgggacacaagtattcgatatcgcttccgtcagtctatcattagccggaatgattggccttgcagttggaattgattatgctttatttatttttacgaagcaccgccagtttttaggcgaaggtatacaaaaaaatgaatcaattgcgagagctacaggaacagccgggagtgcagtcgtttttgccggacttactgttatcgtagcactttgcggattgactgtcgttaacattccttttatgtctgcaatggggctgacagcaggacttagtgtactgatggctgttctcgcttcaatcacgcttgtgcctgccgtcttgtcgatagcggggaaacggatggttccgaaagcaaacaagaaaaaagaaaaacaaagcgcggaaacaaatgtctggggacgctttgtcacaaagaatcctatcatgctaagtgtatgcagcattctgattttgctcgttattagtatcccatctatgcatttggagctgggcttgcctgatgcagggatgaaagcgaaggataacccggatcgccgggcttatgacttgcttgccgacggttttggagaaggatttaatggtcaattaacaatcgtagcggatgccgcaagtgtaacagaaaataaggcggaagccttcgcagatgcagtgaaagaaataaaggaactggaccatgtagcgagtgtcactccggcaatgcctaataaagaagggaactttgccatcattacagtagttcctgaaacaggtccaaatgatgcagcaacgaaggatttggtaaaggatgtacgcagcttatcagataaaaacggagtagatttgctcgttactggatcaaccgcagtgaatattgatatttcagatcgccttaatgatgcgataccggtgtttgctgtactcattgttggttttgcgtttgtattgctgacaatcgtattccgttcgttgcttgtgcctcttgttgctgtcgcaggtttcatattgacgatgacagccactcttggaatctgtgtatttgttttacaagacgggaatctcatcgactttttcaaaatacctgaaaaagggccgatactcgcgttcctgccgattttatccattgggattctgttcggattagcgatggattatcaagtattccttgtaagcagaatgcgtgaagaatatgtaaaaacaaagaatccagtacaagccattcaggctggattaaaacacagcggtcctgttgtcaccgcagccggcctgatcatgatattcgtttttgcagggtttatctttgctggtgaagcttctattaaagccaacgggtcggctctttcctttggtgtgctctttgatgcatttattgtacgaatgacactgattccaagtctgatgaagctgatggggaatgcagcctggtatttgccaaaatggctggacaagattattccgaatgtagacatagaagggcatcaactcacgaaggaaatacagccagaaacagctcatgaacaaaagaaacaaatcagtatgtaatagaaagcagatcttttacgagatctgcttttttgcttcatacaaacgtttattttttagaaaaggttaatcgctaatatcagccatggaaaagaatcatgcatgatcctttttttctctcaccttcccggcaatccaaaacggcaaatagagaagatagaagaagacgatcgtgaccgcttcagctgataaaagataccacggccatggcccgagcacatctaacagcgatgctccgccgccgggcttcttcatcatgtacatatagttcgagttcagcaaacggttgatcaaaaaaatgagagcgccataaacattgacaagaagaaacgtgacccagagagagcgaaccgtcggcttatacctttcggctgcaatcatcaggaggcaggcgagaacgacgatcccgtgggaaatgaaaaattcaaaaaagcggaaatgaggaaagccgtaccttcccaagtcaggcgtcagaatcgcctgcagcgcgcttcccaaaccggcaaaataaagaaatttaaacaagttgaggtttttcgtcaataacagaatgatgacgagataaaccgaaaggtcgctgaggtggagcggcaaacaatagcgcggcgtccatgaatttacatagataaaccaggagtggtagctgatttcagaaatcaataaaaccgccacaaaggcatagcgaatcacccggttccaccgcggtttttgcaacgtcttgcgaaagacgaacaaacaaacgccgagcgctgcaagcaccagcaaagtcagtatatgagatgttgaaaaaaattgaaacgagccgagctgataatctttttgaaagtatgttttcatcctgagcacctgtcatcaaaatatttgaacgttattttgtgacaaaccatgatctattattcaaaaaggccgccgaatatccggcagccgggtgtcacatagaaatagaatcgttttcctctgcgttatcattgacctgaatccgttcaacctttccgacaagaaagatgtaggaaagcgctcccgcaagggcgagggctccgataaagacgagggcgggcgcaaagcttccgccgttggcgagaaagccgatgacaatcggaacgataacggaggcgaggctgccgacaaaattaaatactccgccggtcagcccgatcaaatgcttaggcgctaaagacgatacaagcacccatgtaatggaggccaaaccgtttccaaaaaaggcgagcgtcataaacaaaatgatcagagatgtctgatcgacataattggcaccgataattgaaatagacaggaacaatccggtaataatcggtgttttgcgggcaaccccggccgatacgcctcttttgatcaaaaagtcggacaggaagccggacaacagaacaccggtaaatgccgcaagaaatggaagcgaggcgagaaaaccggattggagaaaatcaaggcctctatattttacaaggtatgtcggaaaccacgtcagaaaaaaccataaagtcgaattaacggcgaactgtccgatatatatgccccacagcttgcgatgagcggtcacttgtttaaaatgcttccaagtaaatgccaatttctctttctcggaagtccggccgcggcggacgatacccccgcctttttcaatatggtcaagttcagccttgtttacctttggatgacgatcaggatcacgataaaagatataccagatcaggccccagatgatgccgatcacccctgttacaataaaaaggccgcgccagccgacgacatgctggatggcgctgagcgccggcgtcaaaaatgcaaggccggcaaattgccccgacgtataaaatgcaatggctgaagctctttcctgttcagggaaccatgaagtcaccacccggttattggtcggaaaagccggcgcttcaaacgctccggtcgcaagacgcaagccgaatagcgaaccgaagccgcggacaaacccctgaagcaatgttgcgagcgaccatgtaaccaaggtaaagccgtagacaagcctcgggccaaaccggtcgacaagcccgccgcccggtatttgcagtgcgcagtaagcccagccgaaagctgaaaaaatcaagcccaattgaacggcagacaagtttaaatcgtccccgattgcagaagctgcaacagagatattgcttcgatccatataattgatcacgacacatacaaaaataaacagcagtacccgcactctaacctttgtcggcttctcttttaaagttgtttgtttcatgacaggccctctccttttatttgattgtaatgacggacaccttttgaaaacggtatcatttttaccattcagctatgcttccgtccttgtgccgccataccggattgcgccagttgtgcccgatatcagccattttacggacgtgatcttcattgatgtccaccccaaggccaggtccatccggaatccggacatagccgtcctcatagaaaaacaccttttgatctactatataatcaagcaaatccgtccctttgttgtaatggatccctaagctttgttcctgtataaatgcattgtggcacgttgcatcaacctgaaggcatgccgccagagcgatcgggcccagcggacaatgaggggcggcggcgacatcaaatgcttccgccatcgacaggatctttttgcattcggtaattccgccggcgtgtgacaagtcaggctgaatgatatcgacatagccgtcagtcagcaggtttttaaactgccactttgaaaacatccgttctccagtcgcaatcggaattgagacgaggctggcgatatcgcggagcgcctcgttgttttccggcagaacaggctcttctataaacatcggccgaaacggttcaagctcctttgccaagatcttcgccatcggcttgtgcaccctgccgtgaaagtcaatgccgattccgatgtacgggccgaccgcttctctgactgctgatattctttcaatcacctgatcgattttttcatgtgaatcgatgtattgcagctcttccgtgccgttcattttgacggctgtaaagcctttatcaaccacctgtttggcagcgaggccgacgtcttgaggcctgtctccgccaatccatgaatagaccttgatcgattccctgttcttccctccgagcagctgatgcacgggagcgttgtaaaacttgcccttaatgtcccaaagcgcttgatcgatgcctgcaatcgcgctcatcagaatgggcccgccccgataaaacccgcctctgtacatgacattccaatggtcttcgatgttcatcgggtctttgccgatcaaatattccattaactcgcccacagccgccttaactgtcgcggcctttccctcgattaccggctctccccatcctgtaatgccttcatccgtttcgatttttaagaaaagccagcgcggcggaattaggaaacactcgaatcctgttattttcatctctgatctcccctttttactgttttgctgcttcaacaaattgctttgcttttttggacagctcttctaaaaacgcgtcattaacatctttattagcccgaacaagcgaaccgccgattcccgctccgaccgcaccggcctgcagaaactcgtgaaggttttccaatccgactcctccagtcggaagcagcggaatatgcggaagcggtccgtggatatccttgatatagccaggccccattgttccgggaaataccttgatgatgtctcccccgctttcatacgccgtcaatatttcagtcggggtaaaagcgcctggaatgctgaccgctccataccgttttgtcagcttgatcgtctcttcattgacggtcggagacaggataaaccgcgcgccggctaaaagcgccgctctcgcagattcgggatcaagtacggttcccgctccgacaagcatttcgtccccaaaatgctctgaaaccgcttcaatcgctttgatcgcttgaggggaattaagcgtaatctccacaagcctgatgccgcccgcttttaaggcgccggcaatgctcactgcctcctccggattgtatccgcggatgatcgcaatcagtttttgttcttcgatgtgtgacaataccatcatttctgccaccctttctctacggtttttttatcggctgacatcttcttcatcagattgttccataaacgcaaacagtgattcgcggtcaggcagcccttcaatatcaccgtttaccgccgctaccatggcgccgacggcacagccccgtttgacagcttctgaaagcggaatttgatcaatcaaacccgataatacgccggccgcaaagccgtctccggcacccacgggatccgctgctgcctgaatctgatagccttccgcatagccgctttcgttcccgccggcataataggcgccttttgaaccaagcttgatgatcgcagtttcagcccccagcccgcggatggcttccgcaatttttttctcatcagcggtgccgaacaaaaaacgcccttcgctcaaccccggaagcacgatatcagaccgtttgataagttcaaacatggtctgccgcgcccgctctccgtcccagagcttttttcgaaagttcggatcaaatacaacgcatttattgtgctttttggcgagctccactgcataaaacaccgcatctgaagcgctttcacttaaagccggggtaattcccgtaatgtataaaagccccgctttctcaatgtattgctcatcaatatcgcatttctttaaaaaactcgccgctgaaagcgtcctgtaatagaagacattgactttggccgcgcttttcctttctttaaaaaacaaaccggtcggcgccgcgtcatcgagcttcacctggctcacatcgactccttctcctctgacagaagaaagaatcatcgccccgaactcgtcttttccaagccgtgtaatccagccggcttttttcccgagcttcgaaagcccgatcagcgtgttggtttctgcgcccgctattctcacctgatagtttcttgcgtatctgagagggccgtcttcattcggagtgaacagcgccattgtctctcctatgctaataacatccatcagaactctctcctttgctaaagcggctttctatatccgccaatgctttctgtaatttttccggctgtgtgaagcagctgctcaacgataacggcctttcttgcgagcatgcgctcctttggcccggcggtgctgatcgccgccttcatcacgccatccggaccatagacaggcgccgccagacaaaacaaaccttcttcattttcttcattgtcaacggcatatccctgttccaaaaatgtctgcagctgcttttccagctcttctctggcagtgatggtatgcccggtaaaccggataaactccatgcggtcgagcagcccttcccttttgtcctccggcatgaatgccaaaaatgccttgccaagcccggtgcaataaagcggtttgcgcgagccgggctgtgcggttgttctgattgacctgttgttatcgatttttgcgatgtagacgagctgatcatcggatagaacggccataaacaccgtttcctgaacgccgtccatcagctgttttaaaaaaggaacgccctgcgatgaaatgtctatcgactccatggcagcggttccaacttgaatcaattttgcccccagcctgtaacgcttgacagcatcctgctgaaggtaaccttcatccaaaagtgtagcggccaaattgaatgtactgctctgaggcagcgaaagttctttgctgatttcctttacggttaatccatccggatgatttgacagcaattcaaatatacgtacaacacgtaccgcggattttactgacatgacaccctccaaaattcacatatgtgattcaaaatcaggatcctgataattcggacgtattctaaacagaaagaaggctcacgtcaaccatcctatcaaacaaaaaaatttttttattaaacttcaaattaccagtctatcgaatcatttatctgaagcatgcaggattcacccgttctgctgcgaatatctcttctcaggaaaacaagaccatcaagggggtttatgtatgaagagaaaaatgatgatgttcggattggcgctatcgatcattgcaggcggcgtggtcgccgatggaacggggaatgcagctcaagcggcccctcaggaaacagccatcgcaaaagatatcgaaaaattcagcaaaaaattcaacgagaaccgcgcctatcaaacgatttaccatttaagcgaaacgatcgggccgcgtgtgacaggcacggcagaagaaaaaaagagcgccgcttttatcgcctcacagatgaaaaagtcaaatctgaaagtaagcacacaaaagttcagcatacctgaccggctggaaggaacgcttaccgttcagggaaataacgtgcctgcgcggcctgccgccggttccgccccgactgcagcagaaggcttggccgctcctctctatgatgccggcctcggcttgcccggcgacttcacagaagaagcgaaaggaaaaatcgccgtcattttgagaggagagctgacattctatgaaaaggccaaaaacgctgctgacgcaggcgcaagcggagttatcatttataataacgtcgacagcctcgtccctctgactccgaatctaagcggtaataaagtcgatattccagttgtcggcgtcaaaaaggaagacggggaaaagctgctttctgaacaagaagcgatcctgaagctgaaagctcataaaaatcaaacctcgcaaaacgtaatcggcgtccgcaaagcaaaaggtgtcaaaaatcctgacatcgtttatgtgacttcgcattatgacagcgttccatatgcaccgggagccaatgacaatgcctccggcacttcagtcgtccttgaactggcccgaattttgaagacagtgccagccgacaaagaaattcgctttattacattcggagccgaagaaatcggactcctcggttcgcgccattatgtcagcacattgtcaaatcaggaagtcaaacggagcgttgccaactttaacttagatatggtggcgacaagctgggagaatgcttcacagctgtacatcaatacgcccgacggttcggcaaacctcgtctggcagctaagtaaagccgcttctttaagccttggaaaagacgtattatttttacatcaaggcggatcatccgaccatgtcccattccatgaagccggcatcgactcggccaactttatttggagagagccgggaacaggcgctttggagccttggtaccacaccccttacgacacgattgaacatatcagcaaagacaggctgaaaacagccggtcaaatcgcgggaacagctgtgtataacttcaccaagaaggaaaacagaaaaccgtcttacagctcagttgcccagtaattttaaaaaggagcagattgaaaatctgctcctccttcttttcatagacccaaagcgcctttcctccccaccgcttccgtatcatcaccttttcagctattcgttatctttattatcaaacaatcaataagcaaccaatatcaatttgttaatttttgtctctttgcttttccaatctccaaaagaaagcaaaaaaatggagccgcatctcgcgctccatttttcaatccttcatcagcttgataaatctgaagctcatcaaaatgctgccgatggcaaccgcaatcatgaccatccccagatcctgaaaatgccccgcggttatttcttctccaaacaacagacccagaatgacggacgaaaagatcgagccaagatagcggcatgtttgaaaaagccccgaagtcgtcccgacgatgtccggcggacttgccgtaaacatggcagcctgcagggcgacattgccgaggccgtagctgaccccgagcaaagagaggatgatgcctttccacaacatcggtgcatcgacaaaaaacaatgtgagcaggatagcgcccgctgccattaagcaagaaccaattaacacgggctgcgtttctcctgaacggtcaatccatttcccgacgaaaggcgagatcaatacgctcgtcccggacatgaacagcatcaaaagaccgctcgtttgaacggaaaggtgcatttcatcctgaaaataactcggaagtccaaaaaacaaacagtagttaaagatgttcagcataataaattgagcatagaccgaagttaacgtcctgcgtgcgatcaacagcctgatatcaataaacggactgttcactctcagctcccaccaaacaaacatcaaaagcaagacgagtccgaacatcccctcggcaaaacggggctcgcccgtgctcaatgagagcagaaatgccagcaggagaacgattccgcccgcaaacagaagaattccggtgagatcaagccgcttgatcacggcgcggacatttaagccggcttttttctcatctttcgggaacatgtacatccccagcaaaaagctgaacaaaataaatggaaagttcacgaggaagatggcgggccatcccccgagtacgattaaaaatccccccacggtcggtccaaaggcggtcattgccgaagaaaaaatggacagcacactgagtgcagacgcctgcttctcatgaatgtggcttctgatcaggcccactcccgaagggtaaatggcgccgctcccaatcgattgaaacaaacgcatgatcaacaagacggaaaaagccggtgcgagaggagcgccgattgccgatacggcaacgagaacaagccctgacaaaaacatctttttccggccgattaaatcgccaatttttcctgtgacaggctgtgcgaccgcactggctagataaaaagatgaaatcagccacgatacggttgcaaatgaaaggtgaaactcatgctggatgctgtgcagcgccaaagaaatcattgaagagttgagcggattcagcatcgtccctgatgcaacggctgttaaaaacagggcccgtttctttttcaatccggccatttacttagggtacagcagcctttcgccagctccgcccgctttaccgcccgcccccgcttccccgctcatcagacggctcctatcatcacagccgaaagcattgaggacggccccgtataaagcagcatcaagccgttgcgactcccggttcatcattgcttccgttccgttttgcaaaccgcattccgcacgtttttcaatatccgatttcatatttagacctcctcgtgctcttatcattttcttgttttcctttttcgattcatgacagtcataacctttgatacagaggagcgttcttcctcttttctgttagttgaaaaacgcatttgacggagctggcatagtgaaaagttcaaaaaaacttatcagtacgctgacaaaagaagaacgccatcgccgggccatgatttccaaaacaaaaagcggaaagaagtcgagcgtcttgccggagatcaagtgaaagtgtggattaagagcgcgctcggcaaactgcagggcaaataccgggcggacgtcttgaaattcgggtatcgaaaaagcggaagggaaatgggatgagattttcaccgaagccgatattacatatcatgttgatatcaacattgacaacttcgggtcaagcggcagaaaaaaatagcagccgggcatttctttagcccggcttccttttattgatccgcttttgttcgaatatgaagcatcttttcatccaagtagttcgcgatgtcagccgcttctttcagctcatcagtgagctggttcggcacttcattgttcaatttgtagtagattttatgctcgaggctcgcccagaaatccatcgcgatcgtcctgatttgaatctccaccttggcgtgctcgacgcggttggtcaagtaaacgggcacttctacaattaagtgaagactcctgtatccgttcggcttcggatttttaatgtagtccttcatttttaaaattttgatgtcttcatgttccttcagcacttcaaccatattgtaaatgtcggataaaaacgagcagacgattctgagaccggcgatatcattgatgtgctccttagcggcctttgtcgtaatatcgcagcccttccgcacaagcttgttaatcaggctttcaaagcttttcacccttgatttcgtatgttcaatcgggttgtggccgtgaattaaattatattcctggctgataatcgaaaacttcgtatccatttgatccaaggcaaatttatagacgaggagttcgttcttccagtcctccatcaggtttctcaaatcttctatctgggcttcaggcagtcctatcatcttatctatcgccatatccattgtatttttctccttataacatcatttcgtttcgttttttcagttaatagacgggtacctccatggtaaagtttcgacttaaagcggagatcaaaaaatagcctggtttaccattttccacatttttaaatttatacccctttcaaaagtcataaaactatcatattctgtaataccacttttcggaggtgagaatatgtcatactctaatagcttcgctttgattgttgtattatttattttgctgatcattgtgggctccgcttttgtaaagtattaattcattcgcgcacgaagccttcttccgaaaaactgcaggttcatatcgaaaggcgctccgcttttcatatgagcctgtttttttgtaatttaaaaagaatttatttccacaataacaaaaaatgtttataataggataggctctgagctgacggctgacggcgctcggaaataaaaactctcccacaaatgaaacttttatacaacattttcgtcttatactgttgttaaggcaattcaataacggaaaggaaaagatcaatgttaaataagctaagaatgttgtatgaaaaaacaacaatgaagtggctgctcaacacttcctattactttctcattctggtgctgctgtttttaatttacggattccatacagcaaatacaggttcatatatttataatgacttttaatggagaagaaaacaatgaaactgattgaaacaattaaaaaatacgcgcaaacacaacccgatacccttgcttttgtgaatgaagaagaaaagctgacatacggagagctttggtcacaatctgagcgccttgccgcaaggattcaaagcgaagctttaacagatgcttctccgatcattgtctacggacatatgaaaccggttatggcggtttccttcctggcttgtgtaaaagccgggcatccgtacattccagttgacgtatcgattccggcagaccggattctgaaaatcatcaacagttcaaaagccgagcttctgctcaataattcaggcacttcggttgacacgggagatgccctcatttccgtagtggaaccgggcgttcttgaaggagacggggtgccggagacagatcccggacgctgggtacatggggaagatactttttacattatctacacatccggaagcacgggaaatccaaaaggcgtgcaaatctcagccgataaccttcagagcttcacagattggatcacgaatgactttccggtggaaagcggccaagtgttcttaaatcaagccccgttttcctttgatttatcggtaatggacctttatccgtgcctgcagtccggaggcaccttatggacggttacgaaagacatgattaatcggccgaaactattgtttgaagcactgaaacagtccaacgtcaacgtctggacatcgacgccttcattcgcacaaatgtgcttgatggatccgtcttattcggaagagctgcttccggagctgagcttgtttatgttctgcggagaaacgcttcctgcgtcagtcgccagacagcttaaagaaagatttccaaaggctcgtgtttttaacacatacggcccgaccgaagcgaccgttgccgtcacttccatcgaagtaacagacgacgtattaaacaagtattcttctcttcccgtcggttctgaaaagcccgaaaccgaaatcgtaatcatcaatgaagacggaaaagccgtccaagacggggaaaaaggcgagatcataattaccggagcaagcgtcagcaaaggctatttaggcgaaaaagcgctgacggaaaaagcgtttttctcttacaacggctcccctgcttaccgcaccggtgacgcaggttacaaagaaaacggccagctcttcttcctcggaagactcgatttccaaatcaaactgcacggctaccggattgagcttgaagaaatcgaatatcagatcaatcagtcccgatatgtgcagtcggcagtcgttattccattctaccgcgaggagaaaatcgagtatctgatcgccatgattgtgcctgccgaacacgatttcgaaaaggaataccagttaaccagcgcgattaagaaagatttgggcagcaagctgccggcctatatgattccgagaaaattcatgtatcaaaaagagattccgatgacagcaaacggtaaaatcgaccgcaagagattaaaagaagaggtaaccgtatgacgccttatggttcatttcttttcttcattatattaggaattttactggcgccgaccatcattctcggactgaacggaaaaagcttccgcttatataatatggcggtttccgttctggttctggcgcttattttttcgaacagcctgcacgggctgatcatgctgtgcctgtttacgctttggcagacggttctgatcaaaggctatatcgcttaccgtctaaaagcgaacagcggcatcgtattttgtctggctgcagcagcttctatcctgcctctggcactgtcaaagctgctgccgtttttcgccgttgacaactgggcaacatttctcggaatctcgtatttaacttttaaaggggttcagctcatcattgaaacccgcgacggtctcattaaaaagcagctcccaatcagcagactgctttactttattctcttttttccaaccatctcgtcaggtccgatcgacaggtaccgccgttttgaaaaagacgatcagacggtttggacaaaggagcaatacgaagaactgctttacaaaggaatcaataaaatttttctcggctttttgtacaaattcattatcggctactgcattaatacgtatgtcataatgaaactgccgtttttgacttccggcagcttctcgcatggattggcatacatgtatgcgtacagcctttatctgttttttgatttcgccggatacacggcttttgcggtcggcgtcagctatatcatgggaatcaaatcccctgaaaactttaataagccgttcatcagccgcaatattaaagatttctggaaccgctggcatatgtcgctttccttctggttcagagactacgtcttcatgcgctttgtcctttggatgacgaagaaaaaatggatcacaaaccggatggctgtttccaatatcggatatgtgctgctgttccttctgatgggcgtctggcacggccttgcccctcagtacatcgtctacgggctgtatcacgcgctgctcatggtcggctttaacttctttgaaaaatggaataagaagcacaagtggtggccgaacaacaagtggacgacagccgtctcaattgtggtgaccttccactttgtatgttttggatttttaattttctcagggaaactaatacactaaaaggagattttcataatggattttaatcaagaagtactttcagttttagcagaggtatgtcaggacgatatcgtaaaggaaaatccggatattgatatattcgaagagggaatcctcgattccttcggcacggtggaattgctgctcgcattcgaaagccattttaacatcacagtgccgattacagagtttgaccgggatgcatggaacacgccaaatcaaatcataaagcagctgaatgagttgagataatgaaaaagcgttttttattcgggccaatcatcttggcatttttactttttttcaccgcgatcttgatcccaaatgcatggctgacaaagctggttcctaaagatcgcgtcgaaacttcagctacagaattaaacccgatgatgttccaggggatgtatcttcaaggcaaagcgcttgaagacccgaaatatctgccgattttcggatcatcggaattgtcccggttagatgcattccatccgtctaactattttaaagtaaacaatcaagggttcacgccttacctggtcggaaaaggcggctcacagtccttgattcacgcgatcaactttgcggcgcagtctgatcaattaaagggcaagaaaatcgttttcattatctctccgcagtggtttcaaaaacacggctcggacgaagcccactttgcgccgaacttctcggctttgcaggcatacgatcttgtgttcaatcaaaatgtcgattccgggctgaagaaaaaaatcatcaaacgcatgcttaaatttcatgcagtgaaaaatgacgctctgctttcagccctttttaaagccgagctcgaccaggacaaggtggcactgtctcttctgacgccgccggcaaaagcttaccaaagcattctggagaaaaaggacatctattattccatggttgaaggagacggaccgaagcggaccatttcccaagatgtaaaaaacaaatcgtgggatgaattaaaacagatggccgaaaaggtcggcgccaaagaatcccggaacaatgagtttaaaatctcaaacggcgtttataagaaattgaagccgaagctgaaaaagcttaaaggccataataaaaagatgaactatgccgagtccgtcgagttccacgatttccatctcatgatggatgttttgaaagaatccggcgcagaaccgctgttcatctcggttccggtccacggcaaattttacgactataccggcttccctaaaaaaggccggacggatttctataaaaagatcaaaaaagaaatcgaacaagagggctttcaagttgctgatttaacgaatcatgaatatgatccgtacttcttgaaagatacgctccaccttggctggaaaggctgggtttacgtcgatcaggagatcgaagctttttataaaaagtcatcataaaaaaggattccccgctggggagtccctttttttcctgttttaaatttttaatgtttccaaaaattctattttacaaatttctctgaaatctattgcgattatcaagagaaggtttaaaatagaagataaatattttttggaaaaagactagaaacggcagggagaatgaatatgacaaaacaaacgatcagcgtacagctcagtacagcaaaaaagcaaaagccagaggctgacaagctcgaattcggccggacctttaccgaccacatgtttatcatggactatacggctgaaaacggctggcacgatccgagaatcgttccttaccagccgattgaaatggacccggctgcaatggtttaccactacggacaatccgtttttgaaggattaaaagcttatttatcaagcgaaggcagagttcttctgttcagacctgaaaaaaacttcgagagactcaataaatccaacgaccgcctctgcattccccgggttgatcctgaaatcgttctggaagggctgaagcagctggttcagatcgacaaggaatggattcctcaagctgaggggacatccctttatatccgtccgttcattatttcaacagaaccgtaccttggcgtcgccccatccaatatgtataaaatgctgatcattttatcgccggtcggatcttattacaaagaaggcatccgccctgtgaaaattgctgttgaaagcgaatttgtccgtgctgtggcaggcggtacaggcaatgcaaaaacggccggaaactacgctgcgagcctgaaggctcaggaagttgcggaaagcaaaggcttctcacaagtgctgtggcttgacggagttgaaaagaaatacattgaagaagtaggcagcatgaacatcttcttcaaaatcagcggtgaaattgtcactccggctctaaacggaagcattttggaaggcattacgagaaactccgtcatccatctcttaaaacaatggggactctccgtaaccgaaagaaaaatttcagttgatgaactggttcaggctcacaaagacggcctgcttgaggaagcattcggcaccggaaccgccgctgtcatttcccccgtcggcgagctgatctggaaagacgaaagccttgtgatcaacaacggtcaaactggagaaatcgccaaaaggctctaccaaacgatcaccggtattcaaaaaggcgctttgcctgacacattcggctggacagttgaagttgataaagtaagccagtcctgctaagcggtttaagctctcttttgcaaaaaagagggcttgcacccttatcgtaaaattcgccggcgccaggctctgtttccaccctacttgcctctttttcaatccgacttgccatccctcccgcataaagcgattccattttatatactttatgttaaaattatcaataaccatgccggaaaggagagattatccgttctgatgtaacacgcaaatcaagaaaggacgctgaacgatggatcaaacaaaattgagcgtctgggaaaagaattacacgttccttttcatctccaggctaatcaaaatctctgctgactgttttgccttcaattctattttatggtttttaatctttgacggaaaaggtgcaatcggcacttccctgcttcttgccgtcacttttctccccgaagcctttttggcgccgattacagggcctttagtcaaaagaagcgccctgaaattctggatgtacttttcggatttaacaagggcagccgtcgtcattactataccgatttgctatttaaacggcttttcaccgatgtggtttgttttaggcctcatgatcatccattcggcaacaggcgcgacatataacccggcgtcaattacgctgattccgcagatcgtgaacgaaaatctcatccaaaaagccaacgcgattctccagtcttcttcagaaatcatcaggctgggagccgttacattgtgcggagtgctgctgacttttatcggtcctgcaacgactttggtcttttcatttatcttttatatcatatcgggcctattcatgctttgcatcaaatacagcatcacccggactcattcacagtctaagtctcttgctcaaagaggtacatattttgcgagattaaaaagaggatttacattggtgaaaaaccacaaaatattatatccgctcgcgatttattgcatcttcatgaacctggcggcttcaccctgggaagccctttccgcggtatatgttgctgaggatttaaacggaacgccgttcatccactcgctgctgaaggcgacgacggcaggaggagcatttttactgggatttatccttgcaaaagtaaaaatcaacaggtacggactcctttttattacggcaggcattctcgaaggtgcagcttattttatcgcaggactgaatactttcctgccgctcgtatttctcgccgcctttgcattcggggcagccatcagctcgattaatgtccccgaattcacgattatccagacatctgtcgaaggggatgaccagcctcaagtgtttgcagtcatccatatgatcacaaatctatcgcttcctttaggggcaattgcctgcggatatgccgcaaaaatgcttggcgcgggaaacgtgattgcaatcggcggcttcatcgaaatcattgcgggcatcggcatcctcatatttactcagcttgccagggcccggcggtcagatctgataaaagaaaaagaagctagcgcaaatatgtagtacgaatgtgacggccgcagtttcaccgggtcaggcgggcgcagcggcgcctccaacaatgaaaaggttccggcaaacacaccggaacctcaaatctattcctatgcttctacagatctaaaaaactgcggaagatgctctttatgcgcttcaagcatttcgtccagtatttgtttcgcaattttgtcggacggaacgagcgggttgatcgtcatggccacaagtgcagtgttgtaatcgcctgtaacagccgcttcagccgcaacgcgttcgaacgatttaatttgctggacaagacctctcacggtgacaggcaaatctccgaccgcgatcggtttcggcccgtttttcgtcatgacacagttgacttccactgcggagtcatcaggaatgcttgcgatcgctccgttattcatcgtgttaacaggttgaatatcgtgcttgtcattgtaaatcgagctgatcaagttgcaggcggcatcactgtaatatgcgccgccgcgcttttcaagctggggcggtttgatcgccagctccggatctttatacagctcaaacaattccttttcaacttgctgaacaacctctgcacgcgttccttccgtttttgaagcctccagttcgtgttcaagcatttcctgtgttttatagtagtagcggtggtagccgcacggaatcaggccaaggccgcggataaagtcgggttcccacgattctccggagatatttttcatcgtcatcgcattttctggatctgccatcgcttcgatcactttgtctttgacgctgacgccgtcaaggaaaacgtcgagtccgaacaccatatgatttaatcctgcaaattgaatgtctatgcggctttcatcaacatcgagcgcctttgcaacccccatcttcatgccgatcggcacattgcagagcccgacgacttttttcaaattagaatagcggagcagcgcttcagtcaccatgcctgccgggttggtaaaattgacaagccacgcgtcggggcacagttcttcgatgtcttttgcaatctcaaggatgaccggaatggtgcgaagccccttgaaaaggccgcccggtccatttgtttcctgaccgatcaccccgtattttaaaggaattcgttcatcttttgctctcgcttcgagcaagccgacgcggaattgcgtcgtgacaaaatcagcgtcttttaaagcctccctgcggtctagcgtcagatggactttgatcgggacgcctgctttttcgaccattcgcttcgccagcgtgccgacgatattaagtttttcttccccttccggtatatcgacgagccagagctcgctgaccggaagctcgtcatgccgtttgattaatccctcgacaagctcgggcgtataacttgaacctccgccaattgttacgattttcaatccttttttcatcaattgacacctccgtggatattcattttttcatagagctcgacaatctccgcggccaaatctttcatggtcatcgcattcattaaatgatcctgggcatgaatcatgagcagtgaaggttcggttttcgcacccttcgcttcattttgaatcaaagctgtctgaaagtgatgcgccctgatcagttcttcgtcagccgcccggatcttttcttttgcagctgcgaaatctccctttttggcttcggctatcgcttccatgcaaaagctcctgccgtttcctccgtgaaggataatttgaaatatcgtttgttccaattcctcggacattttggcaccccttttctatacactgacctgttgaccatcgcttgcagccgttccggtctccagttcgctctcttctttcagcttttgtttatcccacattctaaagaacggatagtatacgacaaacgagatcaacagattgatcagctgcatgaccgctccggaaattttccctcctgttgccaaatatccggaaaagccgggcggcatcgtccacggcacggcaatcccagccggctttgcaacaagacctgtgctcattccaatataggttgccgttatcatcagcagcggcgacacgatgaacgggatcagcagcatcgggttcatgacgatcggcatgccgaagataatcggttcgttgatgttaaaaacagcggggccgatggcgagtctgccgagctgtttcatttgcttgcttcgcgccctaagaaacatcgtaatgaccaaagccaaagtagcgccgctgccgccgatgttgatccaaatctcaaaaaactgcgtcgtaaatatgttcgggagcgcttctccggcttggaaagcgagacggttttcgtccatcgctccgtaccagatcggcgacatcactccgccgacaatgtttgctccatgaaggccgcaggaccacagcagcattttcacagtttcggcaataaggcttccgccgagactgccgccaaggacggaaagaggcgttcccaaaaggacgttgacgacattatggaggctttcaaacggcgtcatttcaattaaaaggcgggccgcccagatcgagccgataacggcgaatcccggaatcagagcgataaatgatttgctgacagccggcggtacgccgtccggcattttgacgacaatatccttttgaacgacccagcggtaaacctcagtggagaacatcgcgatcagcatgccgacaaacagacctttgcttcccattaatgaaatcgggatgccgcctgacactaaaatttcctctgttgcgccttcgggtgtgaacggaatctggtagggggtcgcaagcagaaaagctgctacggcaatggcgcccgatgacagggcatcgatatcatatttctccgccagacggtaggcgatgccaaacgtggcgatcagcgccataatgtcaaagctgacattaaccggatagcttaatttctcagcccattgatcgccgaaaatccccgccatgaattccggatatcccggaatcggcaaattggctaaaatgagaaacagcgatccgataatgattaatggcatggtcagaataatgccgtctctgagagcctgcaaatggcgctgggcggcaattctgccggcaaccggcatgatcttctcctctaaaaatgcattaaacttgttcacttgtgccgcctcctttaagagccggcaagctgttcggcggattttaacacttcagctccattacaagttccgtaatggaccgtattgatgacatcgacggatacacctttcgattctcctaatttctttaattgcgggagcatgtaacggacttgcgggccaagaagcaatacgtcggctttatcgatatgattctgaacctctcctccggaaacggcccagattttatagtcttttccttgttcctctgcacttttttccattttcgtcacaagcagactcgttgacattcctgcggcgcaagctaataagatattcatgttaaatagtcccccttttacgtatcttgtctgatctctcttacagtttcatcatataatgaaaccgttttcatatacacttaatgattttcctcagcgaagaggaaaaaagacaaggggacatcttcatttggcatatcgatgagccggcccgctttttttaaagacggacataaactccccgtacgttttgcatttcaggagttcccggacaatcgccctgtcatctaaaacacggcccaaaaatttgtacatctcctgcaaatttgctgtattgtccttttctacacaaagaaggcagacgaattgaaccctcttattctcccagactatcggtttttgcagcgtgcaaaccgcccaaaaagttgaagcggtttttggtgtcatcggatgcggaatcgcaaccagattgccgaagcaagtgggcgcaacggcctcccgttcaaagaccgaggcttcaagccccgcgtctgcaagccctgattgcgtcacttttccgcacagaaagcgaaggacatcctctcttgaagacagactttcccgcaaaaagacaagctcttttctcgtataagtcgaagcgattccgtcatcttcggcaagcacttgttctattttcgttaaatctccccctcccagtattgtgtttacttgaatcaccggaatgggaagatcatcggacagcggtattgtgctgataacaaagtcgagtgcatggagcgacatttgattcagcttgtagtaatcaaccgttccaaggatctcaagctttgaaccgaatgttgcccgcagtctgtcctgaagcagcatggcgcttccggcccctgaagcacagacaatcatacagcgttttgagggcctgttcatgtttcttctttccatggctgcgcctatatgcaacgcgaggtagccgacctcgctttcctgaatgtcaaatcccgtctctcttttgatgacttcaccggcttgaatacccgcttcaaatgcgagcggataattggccttaattgcatccagcattggatttctgatattcatgccgtatctgcagcgattcaaagccggttttaggtgaaggccgagaccgatttttaattctttgtcatccccaatgccgagggtgaatttttgatcgatggttttcatgatcaattgcgtcagccggtctgtctcttcttcatccatcatgctttcgattgcaccgctgcgaatggcggccataaccgtccttttcgcgccaagcaaatggatggcgatgtaggccgtttctttttctggaaacgccacgtgcagcttttgttcaagagtgcggacaatcgccctcgccacttcatattctttatgattcataatctcctttacatctttggaataaagagaaacatgtttgccgcttcggatgcgtttgcatgcaatggcgacgtggatgagaagattgtttagtccgatatctgaaagagaaatttgatcttcgcttattttttctaaaatcgtttgacggatcatagcaagctcttcttttgggagaatggatatccgggtgttcataatatcaatatccgtttcccgctttggaaaaaggtgctctgcgatgcacgatcgcagcttcatctcatctcccttcagcttaaagccgtaattcggcttgatcttcagctcaatgtcgtaaggtttaagccttttcttcacatctctcatatcgttttggaccgtcgatttgctgatatacatctcagcggctaaatcttcaagtttgacatactcctcagttaagagaagcctttttaataaatagagaatacgctcatttggaaaaacgggagtagaaagctcttgatgaaatgtgtgctgcagaagctggcgaaagaggcggtcattcttgatggagagccgatagcctgcacccctgatcgattggacggcagcgccgtttttggagagaagccggtctaattctttcacatctgatctgatcgtccgagaggtcacatttagctcattggccaaatatgcgctggttaatggtgattctgcccctatcaattcgccgaggataagcttaagccgagcattgagcatagaaaaagaccctcccactaagatacttgaaccgagaacaaacctatacactcaggtatattcattttttttgtgaaatttgtctcatagttaagtaaattctattatgactgcgctttcaagtcaatttggcctttctccaagaaaaaagccggtttaaccggctttcagattctttttctcccttcggtttttaatgattttccatgcgatcggatagatgacaggcgcccatttgacggcgcttttaatcatttttttcatggcttgactccctcctgttttttttactgttttccctgatgaacgggagccaaaccttttaactatcttgagacatagcggttcccttttatccagaatcgccaagggtattccctcgcttcacctgagttgtcaatgccaattcgcggaccgctcaaaatatcttggggttcatacccttttgcgatataaagcggcggccccgtcagcggtctgccgtaatcgttcatcgtgatggaaagcgcctttgtcagctttcccggaccgtttgtccaatcgcgcggtttctttccgctccttcgcttctccatcagcgcgaggccttcatgaggttcaagcgctctgatcagcacggcctcaggttcatcggctcctccgcttacaacattgatgagtgtgtgggtatgcatggtgtacgtatacaccacgccggcttcacgatacatgatttcggtgcgctttgtccggcggttgccatagctgtgagctgctctgtcccctggccctttataagcctctgtctccacaatatatcctgaagcaggcccttcttccgtttctttaacgagaagacagcccaacagggacctggcaagttcaattgttggcttgttgtaaaattcgagcgggagaggttcgtgagctggattcatttttgttggcctcctttttgctaaaaagcaaatcgcctctttgtcgattgtgatatattttaccattttcgacagacgagatgccagaaatgaaggcaatgatgaatgagatgatttattggtcttcagtggatgacattgacatatctgtattattgtatacaataataattatattctgaaaaaaggaggcgaaagcttttttcatgcactcttcaaatccagtcaaaagacagtctgcaagtgattacgcttataacgaattaagaacgaaaatcatcgaacttgaatatcctccctctgaacagcttgctgaagacagtcttgcaaagggtttaaacatcagcagaactcctcttcgccaggctctttaccggctggagcttgaaggattggtcagtaaacagccgaacggccggcttcgcgtatgcccgatttcgctcgctgaagcgaaagaggtttttaaagtgcgtgaagcgcttgaaggactactcactgccgaagccgcacagctggtgacgccggagagccttcatcagcttgaagaccgcatcgaactgatgaagctggctgccgtaaagggccgcaaaacagatacggtcaaatacggatcagaatttcattctatcttgcacgccatcagcacaaatgcaaccgcaaaacgttttctggatcagcttgaaagcaggattgaacggtatcgcagaatcagcggatacaaaaatcctgactacaaaccgtctgtatctttcaatgaacacttggatatttttaatgccgtcaaagaaaaaaacagcgttttggcagaagccgccatgcgttcccacattaaacgaagcttacgttcaattgaagaaacgctcgaacgttcatactaatccgccgaacagccaatgccattctcacagcacgtttttgacacaaatgttaaaaaacgaataagaggtggaaaaatgggcaaacaaggtgtatttaaaccgggattagaaggcgttattgctggagaaacgaacatttctttcttagatacggaagcggaacaaatcgtcattaaaggctatgatttaatcgaacttgcagaacaaaaaacatatcttgacctcgtctatcttctccttcaagataagctgccagatccaatggaattgaaaggaattgaaagcgctttaaaaagtgcgtatgaactgcccggcggaatctatactattctgaagtcgcttccgaataatacccatccgatggatgcgctccgaaccgggatttccgctttagcaggatatgatcccgaattgaatgacagatctcaagcagcaaacagaagcaaagcgctgcgcttgatcgcacaggttccgaatattaccgccaacagctaccgcatccttcaccagaaaaacgtcatcacgcctgacaaacagctttcattcagccagaactttttatatatgctgacggaaaaagaaccgactccccaagaaacagccgtctttgatcagacattaatgctttacagcgagcacgaaatgccgaactccacatttgccgcaagagtcatcgcatcgacaaacacagatatatacggtgctttcacaggcgctgcagcatcgctaaaaggacatttgcacggcggtgcgaatgaagcggtcatgtacatgctgctcgaaggagaaacaaaatcgggcttctgcaagctgattgaacataagttaagcagaaaagaaaaaatcatgggctttgggcaccgcgtctatatgagaaaaatggacccgcgcgcagccttgctgaaaaaggcgctctattcgctttctcataaaaccggcagacaggatttatatgagatgtgcgatgccggcgaaaagctgatgcgcgaagaaaaaggcctgtatccgaacctcgactactatgcggctccagtctattacctgctcggcataccgatcgatctctatactccgatatttttcgcggcacggtcggtcggtcttagcgcgcatgtcattgaacagcatgaagacaacaggctgttccgcccgagagttcactatacgggaccgcgtcatcttcatccataattcgctttgattcagaaagaagggagatagatgttatgaaaactgaaagtcaaacgctccaaaactgtgatcaattgctggaagagatcgccgactatacggtaaatgccaagatttcaagcgaagaagcgattgaaaccgcccgttacgtcttaatggatacactgggctgcggaatattggcgctcaaatatccggaatgcgccaagcatctcggcccgattgccccgggtaccgtcgtcccgaacggcacccgcgtcccgggaacgcaatttgagcttgatcctgttcacggcgcctttaatatcggctgcatgatccgctggctcgattataacgacacatggcttgcggccgaatggggccatccgtcagataacctcggagcgattttagcctgcgccgactatgtcagcaggcagctgctcgcggcgggcaaggaaccgctcacgattaacgatgtcctgacggcaattgttaaggctcatgaaatccaaggcgtccttgctctcgacaacagcttaaacagaaacgggcttgaccatgtgctattcgtaaaagtcgcctccactgctgtggcatgctcactattggggggcacaaaacaggatgttatcaatgccgtctcccaggcctgggtcgataattcaagcctgcggacgtaccgccatgctccgaataccggctcgcgtaagtcctgggcagccggtgatgcgactagccgcggcgtgaggctcgcgatgatgaccttgaaaggcgaaatgggatataaaaccgctttgtctgctccaatgtggggttttcaggatgtcttattcggaggaaaagaattgacgctcgccagaccgctcgactcttatgtcatcgaaaatgtcctttttaaaatttcgtatccggctgaattccacgctcaaacggctgctgaagccgcgatcaggcttcaccctgaagtgaaggacagacttgatgacatcggccaaatcgtgatcacgacgcacgaatcggccatccggattatcgacaaaacgggagaattacacaatccggctgaccgtgatcactgccttcagtatataacagcgatcggactgatctacggcgatattaccgctgaccattatgaagacgaaaccgcgcaaaatccggagatcgacaggctgcgcgaaaaaatgacgacagtcgaaaacaaacagtattccgtcgattatctcgacccggaaaaacgctcgatcgccaacgctgttcaagtgttttataaagacggcacacactcggaaaaaatcgcggtcgaatacccgattggtcatcggcgccgccgcaacgagggcatcccgctcttaaaagacaaatttatcaataatttaaaaacgcgctttccggcggggcaagcggaacgaatcaacgccctgctgaatgatcctcacagattaagcggtgcacctgtaccggatttcatggaattgtttgtcatttaggaggttttgaatatgtggattgtctcgaaacaatcaactcaggaagagctggccaatgcattcagaaaactgatgaaagcacctgatattttgaaaatacccggtgttcatgacggaatggctgccattaccgcaaaaaacatcggcttcaaagcgctctatctctccggggccgcctacacggcaagccgcgggctccctgacctcggaatgatacactcccaggaaatcgctgaaaaagcaagcgaacttgtgagagccgcaaatcttccgcttttggtcgatatcgacaccggctacggcggtgtcctaaatgcggcacgcacggccgccgaaatggccgagagcagagtcgcagccgtccaaatcgaagatcagcaactgcctaaaaaatgcggacatttaaatggaaaaacgctcgtacccgcagaggacatgatcgcaaaaattagagcgataaaagaaaccgccccttcgctcgttgtcgtggctcggacggatgcaaaagcagcagaagggatggaagccgccgtcaggcgcgccaatttatatgccgacgcgggagccgatgccatctttcctgaagcattaacgagcgcagccgaattccgggaaatggcttcttccattaaagcgccgctcctggccaatatgaccgaattcggaaaaacgccttattatacggctgacgaattccaaatgctcggctgcagcatgattatttaccctgtgacttccctgcgcgccgccgcgaaagcttatgagcgggtcttcgcggagattttcgaaaaaggcacgcaaaagggtgtgctcgatgacatgcagacacgcgaagaattatatgatgcgattcattactacgactatgaaaaactggacgaaaatattgccaaaacggtgcttcccgaaatcggaaaagaacaccgttgatacgcgaaacaaggctgccgaatgatcggcagccttctccacttacaacagctgcaacatcgcaccgccgacagcaccggctgcaacgatgatccacggcgagagcttccagtagacaagcaggctgaacaaaaccgcagcgaatgcaaaatcgatcggcgccaatacggagctggtccagatcgggtgataaaacgcggaaatcaatatccccacaacagctgcattcactcccattaaagcgccttttactttaggattgcggcgcagcgtatcccagaagggcagcgtccccagaatcagcaggaacgccggcagaaaaatcgccgctgtggcgagcaatccgccttgccagccgctgatcaccgcaccaagatatgcagcgaatgtaaacaaaggccccggaacagcttgtgcggctccatatccggccaaaaatgcctcttcacttaaccatcccgccggtacaaattcccgttctaataatggcaggacaacatgccctcctccgaagaccaaagaacccgacctgtaaaagctgtcaaacatggcaatccagccggaagatgtcatttccctgagcaccggcagcaaaatgagaagcccgaaaaacaagctgagacagaccgctgcaaaccggcgcgacacaggaaactgcatgacggaatcatccgtttcaacttgctctttatagataagatatccggcgaaagcggcgagcaggatgactccgacctgtgtaaaagccgtctgccagagaagagtggcgaccagagcaaacagcgcaatcgctttgcgccttttatcaggtgtcagcttttgcgccatccccataacggcatgggcgactacggcgacggcgacgattttcagtccatgaatccagccggctgttccaatatcgaagccttgcagaaccatggcaaataatacaagcgctatgacagatggaagagtaaacccgatgaacgctgagattccgccgaggacgccggctctcatcacgccgattccgatccccacctggctgctggcaggaccgggcagaaactggcataaagcgaccagatcggcatagtttttttcgtccatccattttcttttacggacatattcggcatgaaaatatcctaaatgtgcgatcggacctccgaatgatgtcaatccaagcctggttgaaacgaatagaatttcaagcagcgacttcaagcttctgtccgctttatgctttgtcatcattccactcccctattctttaatttctttaaacagttcatatgctttcaatctggcttccttcagtacgcttgctcctttttccgtggttgaatagtattttctgatctttccgtccacattctgttcttcttttcgaagaagtccgtcagcttccatagaatgaaggatcggatacagcgttcccgcactgatgttatatccgtgctctttcaattcctcaagcatccacaatccgaaaatcgggtgttcgctggcgtggtgcagaatatgaatttgaataaatcctagaaatagctttcgcaataccttatcttccaataccgcaccccctttaacgaaattcaatatcgaaatccgatatcgataatatataacgaaagtgtagcatccgttccctttcttttcaaggtcttttgcccttaaaaaaacaagcccaaacatgggcttgcctgtttccaatcatttacgactgatactgtacacgatgaagatttgcgaaaataccgccgcgctcaaccagttcatcatgtgtcccttcttctgcgattccattctctgtcacgaccacgatccggtcggcattgcggatcgtagcaagtctgtgggcaatgacaagcgtcgtcctgtcttttgcgagctccgtcaaagcgttttgaatcacctgctccgtctctgtgtcaagtgctgatgtggcttcgtccaatatgagaatcggcgggttttttagaaacatcctggcgatggcaatcctctgcttttggccccctgacagcttcagccccctttcgccgacctgggtttcataaccgtcggggagcgactcgatcagctgttccaaatgcgccattttggcggcccgctgaatttcttcatctgtggcatccagttttccgtaggcaatgttttcgcggagcgttcccgtaaaaagaaacacatcctgctggacgatgccgatttgcgaacggagagagcgttttgtcatatcgcgaatatcgatgccgtcaattgtgatggccccgccgtctatatcgtaaaagcgcggaatcagcgagctgatcgtcgttttgcccgctcccgacggcccgacaaaggcgacggtttctccggctttaattgacagatcgatgcctcgcaggacgggtttatgtttttcatagccgaacgtcacattcttgaagacgatgtttccttccagcgccggaacatcaatcgcatctttgcggtcgacaatctgcggctttgtatcgatcaactccgtaaaccgcttaaatcctgccattcctttaggataaagctccaaaatggcgctgattttatcaatcggcttaaacagcacgttgacataaagaacaaacccgacgaattccccgtaggacatattcccggaaaaactgagccaagctccgaacacgagcactgccagaatcatcagccgcgtcatcaaaaaggttccggcagtcgtgagagccatcgttttgtagcccttcagcttcgccttgcggaacttttgattgttttttaaaaaccgggatatctcaaagcgctcattcgtaaaagattgaacgacgcgaacgcctgaaacgctgtcctcaaccctggcattaacatcggcgatttcgctgtacatctggcgccaagcccggttcatcctgatattggaatagatgatcaagataatcaataacggcacaaacagaactgcaaccaatgcaagcttcacattaatcgtcagcataatccaaaatgcacctaaaaaggtcatcacggcgatgaacaaatcttccggtccgtgatgggccagctctccgatatcaaacagatcatttgtgatgcggctgatgatatgtcctgtttttgtattgtcaaagtagcggaaagattggcgctgtacatgttggaaaagctcctggcgcatatctgtttcaatgttgatgcccagcttatgcccgagataattgacaatgtactgcagacctgtgctgagcaggtagatcagtaagaggccgatgcttacccagacgatttcaagccagtctcccccgggaatcagcgtatcaatgaaccactgaacaactagaggaaaagccagctccagcactgcaacgacgatcgcgctgctgaaatcgatgaagaacaaacgtttatgaggtttatagtatgaaaaaaagcggcgtatcataggatgatgtgcactccttttgaaaatctttacgagattgatcgtatcacagtttggcatcggaagtgcaaaaatttcgaaaaataattgaaaattattctcaagtaggctgttttataaaggaattcccgcttcttttgcttcctgtgcaacaagcttagcgatttcttttgccccgaagtcgcaaaagtgggtgtcatccctggctccgtccggatagttggggtgttcccccggttcaagccataaatacagctttttggaagcttccggtcctagcgattcaagcaattgacggcttttgaaggcgagatcgataagcggcacccgaagctcttccgcaagctgtatcatcgcatcaggatagtcgccatgggtatttttaaagcggccatcgcttgcaaatgatcttctctggaccggtgtaatcagaacaggattggctttctttaaccgtgcctcatctatataccgggtcaaatgctgcttgtaagttgtgtatggctctgtatagcgatcatccggtttttggtcgttatgaccgaactggacaaacaaataatcgccgcttttgatctgtgttatgattcgcttcagcctgccttcttcaataaagctttttgagcttcttcctgatgccgcttcattgcggatcaaaacacctgcgcttaaaaactcgccgattttctgcccccagcctgcacgcggcgccctattctcatcataatcgcaaaccgttgagtccccggccaaaaacaactgaatgtctcgcatcatccatccccctgatccctttttatttatattaaaacgcccctcaaggaactgcaacaaatatacataattaaccattttgttctttatacgactcctttttataaaaaaaaggcgtcaattgacagaaaactatcaatttatactaatttttttagaaatttatctaaaaatatttacttggatggtaaatggtgatagattaaacaaacaagaaaaggaatatagttgatcgcgatctcatttctgccttttcttgaaaataataggacgtcctctactttaacttaaacattgcaattaggaggaacttatcgatgctaaacgaaaattcattcgtaaaatcagtgttggtctattagcttctgcagcattgttttcatttatcattcctacccaaggagcaaatgctcaagaggtgaaaacaaatcattttagaggaccgatcttttgtccgccgccattcaagccggcacctaaaccacagccgcctcaaaaaccgcagccggacaatccgcaaccggataacccgactcagaagcctgtgcttgaggcaaaaactattaacagcaataaagagtggtcaacttcagacatcgaaattacttatagaccaaacgcatttgtcggttcaagctatgttgaatttcattttccgtaccgctttcatgcaagcacaagagatacactaaatggaaaaacgcttgactatacacaaattttaaatgatggacaaacggtcagagttcctgtctatgctttaagttcctctgagttcaaactggtcatggttcggaaaacgcttccaaatgccggcactcacagaattactgctgaactgcagcaaaatggaaaaaacatcaaccatgctgaaacaactttggagattgtccctcgttaaatcaatgttcggcccgccggcatgaatgtgccggcagccgttctattgtatttttctttacatatcatgcattttttaaatgtttttagaattttcctttaaaaatatttacttgattggtaaatgatgatagattgatggagcgggaaaaggaatatagtagattccgaacttattttttcctttttcatcattttttaaaaacatttattaggaggggtaagtacatgttgaaacgtaaatttatcggtaaaattggagtcggcctattaacttcagccgcattgttttctttcattcttccgacggaagaggcgagcgccactttttacagaaacgctccgacgctgcatgtcgagacggttgacagcaataaagaatggacaacttcagacattgaagtcacttacaaaccgaacttttttgtcggttcaagctatgttgaatttaacttcccataccgcttccatgcgaatacgagagattcgctgaacggcagaacactgaactatacacagattttaaatgacgggcaaacggtcagagtgccggtttacgctttcagctcttctgagttcaaactggtcatggttaggaaaacgcttccaaacgccggcactcacagaatcaccgcggagctgcaaaagttcgggcgaaactacaaccacgcagaagctacagttgatatcctgccacggtaaaattttaagcctgccggcataagagccgccaggctttttttcatttaagcgctgcccgccgaaccagtatgttaaaacaagcgagcgcgctgatattgcaaaacagaatgacgactgccatcggcaaagctgtatggcttccggcaataccgacgagcggcgccgcggcagctcctaaaataaacggaagcagtcctagaagcgcagatgcgctcccggctgatttcccctggctctgcatggccaaggatccgctggtcgtcgtcacgattccgatgcaggaaaccacgacaaacagcgggattaaaataagaatcagcggagctttaaaaaagacagaaacaaataaaacaacgcttgcggtaaaagacagcagcaaaccgctccgcaaaagggacgcttcaccgaaccggccggcaagcctgcccgtaatctgagctgcgataataatgcccaggccgtttaatgcgaaacaaaaactaaaggcttgagccgacaatttgtaaatgtcctgcaaaacaaacggagaggccgatatatagccgaacatccccgctacgatcagcccttgcgccaaggcgtatcccataaatgtacgctggccgaagagccttccaaatgatacaaacgtctctttgaatccgcctgccgtacggttttccggagacagcgactctttaaccccgaatataacggacaaaatcatcagcaggccaaaaaggccgatgatgaaaaatacgccgttccacgtcgtccatttcatcagctgtccgcccgctaccggagatatgataggcgctatcccgttaacaagcatcaagagcgaaaagaactttgtcaattctgttccagaatatagatcacgggcaatcgcgcgtgatatgacgatgccgcctgcccccgccgcgccttgaataaagcgcatcgcgatcaaaacccatacagaagatgtcatagcacataaaaaagaggccgcggcaaaaacggacagcgacacgatcagcggaagccttcttccaaggacatcgctgaaagggccgatgacaatttggccgattgccagccccagtaaacacgatgttaaactgagctgaacgacggaagcattcgtatgtaaatcagttgccatctgtggaaggccgggcaaatataaatcgatcacaaccggaccgattcccgataaaatacccaatatgacagcgatccataccctgttcggctttgctttcgaatgagccgcaagatctgcctggctgttaagcgtacccattggatcactcctttattatatttttaaatacgccctcgaaaccttccagtgtattgtataccttaagttatgaagatgacaattagaaaaaccgggcgagcccggctgattagtaagattcatatcttttaaaaacaaaaacggtgcacatgaacaaaagaattacaattcccaaagacgaaaacaccatccagccgaaagcatggtcccatgaaccgtgcatgataaaataatcagcctggcttttcgccttatcaggcatccattcggtaaagcggggaaataaggatcccgccaatgaaacgaaggcgatgaaacagatgctcatgccggcaatccccccgatatggcgaaacagagcactgaaaaacatcgtgaccgacatgacaaatataatccatatactgtacacggataaactaaataaaaaccggtcaaattcaaccttgccgaatagcagatttgtatagtagaaagccaaaccgtagcttgcagcaaacgaaaccaatacgagcagcacctgctgaagccacttgctgccgatatactgaagcgggctgacaggtctcgccatcaccaatgaaagggatccttggtttcgttcgtggacaatgctgcccatcacactgaaaacgaaaattgccgtaccaaccgtgccgaactgggacaaggtgctcgccattacctcttcacctctcggccttggtatgtcgatcacggatccctcaggcaaattcccggccatatcgataatttgaggcatataatacaggctgagcggctgaatcaagcccagaaggatcaaaatgacaggcagccaaagcagctttccgtctctccagctttccgtccattctttttgaaataacataaaaaatgaattcatagccccatcaccttcagatacatatcttccaaggacatcgttttttgttcaaaacgaacaatcgatacttgtctgttcaagcattcagccaacagtcggcggctgtcagaccgatctgttaaataaaattcagcttgtgaaggcttatgatacacgactttgctgacataaggcaggtgttccagccatccttcaagactttcttcagctgtcagcatatatgatggctttaaatgacggttcttcaatctgtgaagcggaccagaccatttgacagccccttctttcagcatgatcacttgatcgcacacctcttcggcatcatgcagcacatgagtcgaaaataggattgtcatcttcttttttaaatccttcatcatatcaagcacttcgcgccgccccgccggatccagcgcggaaacaggttcatccaaaatcaacagcctctgctcatgaaccaaagcctgcgccagcccgagcctttgcttcatccctcctgaaaaaccgccgattttccggtcttcttccttttccagaccgacatagcgcaaagcggttcgactcttttccagggcttcacgacgtttcattttggaaagccttgcagcgaataccgtatattctaaagctgtcatccatgaaaaaaacgcaggatgctgaggcaaatatccgatttccagcctgtttatcgattctctccccaaaaagcggatgcgtcctgatgtaggggccaataaaccggaaagcatttgcaatgtggtcgtttttcccgctccgttcggcccgagaagggcaacgcattgctgatattcaaggtcaaagctgacattttggacagcttggtgctgctgatacatttttgttaagccattgacggacagcatcacacccgcctcctctcatatgtttttttaccgatgataaagtaagagacgggaccgacaaaactgatcccgaaaatgatcaaaatccacatccactttgggccattcgttttctcctgttttatgcaactgaccaatgcggacactgctaaaatgaaagacagcacaatgaaaggggcgagcagcgcccaaggtatatctgctccagtcatgataacggcctcctttttttatgaaacggccttacaacaaataaataatagaataataaaggcatcggtgtttggatcaagccccatattccccagaaccacgcattggctccctttttcttcgcattaagaaatagaaagatactctgcgcaaataaaagcggtgaaatgcaaagcagcagcagcagcagtttttcctgagtcatgtcaagattcatttaatcagcctcctcatcagccgtatgccgccttttttctatcagggcaagcgctggcagcaagataagcgccgctccctgcaccatgataaaaacagccggtacttgaacggaaatcgtcaagtaggccgataaaatcaccagcgccatgacgataaaacaaagcaattcctttttaagcgcccgcttgcgctcttgcttaaaccgcgctaaacgctgattcagttcaaatgcttgaggaaccggcggcacaaaattatcatcaattctttcgagttcgcgtttcaaatgtgtaaccgtttctttttcatctcgttcattcactgtccccactcctttcgaattttctttaatccatgatgcacgcgcgatttgacggtaccttcttttattttcagcatgtttgccacttcagggtaagtaaacccgtaatagtgtcttaacaagattggcattctgaactcaggctcaagcgcagcaaacatctccaagtattcgctccattcgtggccgtgaagggcagaattccatttcatttttcgcaaggcttcctctcctgctgcttgcgttttgcggttttcgcgttttttccggcgctgatggtcgataaacagccgggaagcaattgagatcagccatgttgaaaattttgcattgccctgaaactgatgaaggctgacatacgctttcagcatcgtttcctggaccaagtcctctgtgagatctgggttcagcgttaatttcagaacatattgatatacaaaggggtaatgaagctgaaacagtttcgtaaaagccgcatcttcaccgtcttttgcccgtatgatcagttctttttcatctgcttgatccactaaaacgcaaaccccctttctttttgtctctgtatctaggacgacgcctgcaagcaaaccgttcaattctatttcaataagataaaaaatcatcttgtttttcggccgggatttatgatgtacttgaatttaaaggggtgtgagtaaaaagggatggagcggcaaaaacaaatcgtctatgaagaaaaacaaattttaaggaaagatcatatgatcttttggggtgccgtcttttgtttctggtttgctacatacatctatgtccctgttttcggattatatttagacaacatcggattttcatattcagcgataggaatcgtacttggaagctacggcgtcactcagatattactgcgttttccgttcggcatcctgtctgatgttctttcgccgcttagaaaacagctgttgatcagcggctttgcaatgtctctgttgagctgctgcatatttctgttgtccgattcgttcatcatggtgatcacagccaggctgctcgccggtatgaccgcggcgatgtgggtgatggcaaccgttttatactcgcagtattttacaaaagatcaatcatcaaaagcgatgggcatcctgcagtttttaacggtccttccccaattcatcagcatggcagtcagcggctacctcgtccatttgttcggctggatgtttccgttttggatcggtgttgccgtatcatgcatcggactgattctgtcattttacattaaagataacgggccccgccatacggccaaggggatggctttgtcagactatgttaaacagacgttgcgtcttcctgatttaaaagcgattacaacattatcgtttttagcccacgctgtactatttatgaccgtgttcggatttacgccgatttacgcggaatcggtcggaatcgatgagaaacagctgatttgggttatgttcgccttttttgttccgcaaacgctggcttccgtgtggtgtatcttttacaaagtaaaggccgccgatgcactgatatggatatcttatgtgataacggctgttttcttttgcttgctgccgtttgccgaaacccttttcgcggtatgtatcgtccacgccgtgacaggactgacattgggatttatttttccgcttttggtcagcaaagtcgttcagcttggtacgcctcagctcaaaatgtctgtgatgggtttctatcaatctttttatgcgctcggtttttttctcggaccggttgtggcgggaaaagtggctgaactgttcgggctgccgaaggtgttttggtttgccggcgcattgtcactggccgctgcatgtatcatgcttttttccaaacagtttcgtatatttacagcaggaagacgggataaatcctcaaatatcgttcagccgacgaaggtcttccgtaagtgaaacagcgatgaatcccacaagaggttcatcgctgttttcttctttaatacgggtcttgagagtgccctttttcttccgcctgtctcggggcatcttcggcgccttctgctccgatcggctcccggctggatgtattttggctggaggcgttttttaatccttcctcgactctgcttccatattccttgtcgcattgcttcagcatatcgatcatcttcgtttgaattctttggtcgcacggggcaagtgtattgaccagattcgtaatcagctcgtccttttcccagtcttcgaaatgcctgtaagtgtccccggcctgcttgaaattattctgcctgtcgatactttcgcgcacaaggtttccttccacatgcggggtgtattctttgccatcctgctttgcttctttcagcccgttgatggttgaaggttcatagttgatgtgcgggctttgatttttgcctaaatcgaccttgtactgcatctggccgccccgctgattggttgccaccctttttttcggcgcattgatcggcagctgcagatagttggctcccactctgtagcgctgtgtatccgagtaggaaaaagtacgtccctgaagcattttgtcatcggaaaagtcaagtccgtcgacaagaacccctgttccaaatgccgcttgttcgacttctgtaaagtagtcttccggatttttgtttaaaaccattttgccgacaggcagccaaggaaattgatcttcaggccacagcttcgtgtcgtcaagcgggtcaaaatcgagctcaggatgctcatcatcgctcatgatttgaacgaacagctcccactcgggataatctccgcgctcaatcgcttcatataaatcctgtgtggcgtgattgaaattcttcgcctgaatttcttccgcctctttttgcgtcaagttttttatgccctgcttcggttcccagtgatatttcacaagcacggcttccccttcttgattcacccatttgtacgtgttcaccccggacccctgcatctgccggtagttcgccggaataccccaaggcgaaaacaaaaatgtgatcatatgcatcgcttcaggcgtgttggaaatgaagtcaaagattctttcgccatcctgcaaattcgtaaccgggtccggcttaaatgcatggattaaatccggaaactttaccgcatcgcggataaagaagatcttcaagttgtttccgaccagatcccagttaccgtcttcagtgtagaacttgaccgcaaatccgcggggatcccgcagcgtttccggtgaggatatcccgtgagtcaccgtcgaaaaacggacaaacaccggggttctcttgcctttttcctgaaaaagctttgctctcgtatactttgagaccggctcatcgcctgctgtcccataagcttcaaaatagccgtgcgctccggctcccctggcatggacgacccgctctggaaccctctccctgtcaaagtggctgatcttctccaggaaatcatagttctccaatgttgatggcccccggttgcccacggttctgatattctgattgtttgtgatcgggtggccctgccggtttgttaacgtatcatcagtctccatgtcagatttctgctcgtttgaatgctgatccattcttcttccccctttatttggaattaacaataatttatcccaatccagaaaagttattcagcatttatcatgatcaaatcaacgataataaatttttctttataataattataaataaatattgtttttttcttgagaaatgttatcattgttttgtaattaaaatttacgcgaggtgatcctttgatgacgacaaataaaaacaacctaacaaccagctggggcgctccagttggagacaaccaaaactcaatgacagctggttcacgcggaccgacgctgattcaggacgtccacttgctcgaaaagctcgcccacttcaatagagagcgtgtgcctgaacgggttgtgcatgcaaaaggcgccggtgcgcacggttattttgaagtcacaaatgacgtttccaaatatacaaaagccaaatttttatcagaagtcggaaaacgcacgccgttatttgtccgtttttcaactgttgccggcgaaaacggttcagccgattccgtccgcgacccgcgcggtttcgctgttaaattttatacagaggaagggaactatgatctcgttggaaacaatacacctgttttctttatccgcgatgcgattaaattccctgacttcattcatacacaaaagcgccatccggtcacacatttgaaaaacccggatgccgtatgggatttttggtcattgtctcctgaatccctgcaccaggtaaccatcctgatgtctgacaggggcatccctgcgacttaccggcacatgcacggcttcggctcccacacattcaaatgggtgaatgccgaaggagaaggcgtctggatcaaataccacttcaaaacagaacaaggcattaaaaacctgaccgaagaagtggggacaaagattgcaggtgaaaaccccgattatcacacacaggacttgtatgaggcgattgaaaaaggcgacttcccggcatggaagctgtacgttcaaataatgccgctggaggatgcggatacgtaccgttttgatccgttcgatgtgacaaaagtatggtcgcaaaaagattatccgctgattgaagtcggccgcatggttctaaaccggaatccggaaaactatttcgcagaggttgaacaagctacattctcccctggaacattggtgcccggcattgaaccgtctcccgacaaaatgcttcagggacgcctgttcgcatatgcggatgcacaccgctaccgcgtcggcgcaaaccataacagcctgccgatcaaccgtccgaaagcggaagttcataattatcaaagagacggacaaatgcgctttgattcaaacggcggcggctctgtctactatgagccgaacagcttcggaggccctcaggaaactccggaaaacaaaacaacggcttatccggtgtcaggttcggcggacagcacggcctacgaccataacgaccactatacacaggccggagatctttaccgcctcttgagcgaagaagagcggacccgccttgtcagcaatatcgtaggttcgatgaagcaggtgacaaaagacgaaattaagcttcgtcaaattcagcatttctataaagcagatccggagtacggcacacgagttgccgaaggattgggcttgtctgttccgcaggaagtttaaggctaatatcatttcaatcattctcaatgaaattctcattttctcaggtacaggcacccgtcctcttaagcatgcgggtgcctgcccttaatcaaagaacgacaggggatgttacgtgtggaagacgagcagctcgtccctttattaaaaaagcggggtttacgaattacagctcagcgcgtcctgattttaaaaacgattgcttctttgggcggccatccatcggcggaagacattcaccgggaattgccgtacatgagtctcccgacaatctacagcaacttgaaactatttgtgaagctcggcattttaaaagagctgtctcacggagacgcaaaaagcaaatatgaactgtttacatcacagcattatcatgtcatttgtaaatcatgcgggaagatcgctgatctggactatcctcacctcaaagaggtagagcatgcggcagcacaattgacgaactttaaagtgaactcgcattttctaggaatctatggaatctgtacaacatgccaagaacagcagcagaggtgaagacatatggaacgaaaaaaagtcggcctgttagtcatggcatacggaaccccttatcaggaagaagatatcattccgtattacacgcatatccgtcatggaaaacgaccgtccgatgatatgattgaagacttgaaaaaacgctacaagcatatcggcggaatctctccgctcgcgaaaattacgctcgctcaggcaaaagagctggaaaaaacgttgaacgagcgccaagataaagtcgaatacgtgatgtatctcggcttaaaacacatctctccgtttatcgaggatgcggttgaacaaatgaaaaaagaccaaattgaagaggccgtttccgtcgtcttagctccccactattccaccttcagcaccgaagtatacaatcggcgcgccaaacaggccgcagcagcaatcggcggaccacggatcgcatcgattgacgagtggtatcaggaagaaggctttattcgctattggtctgaagaaatcggcagcattttaaacgacatgtctgaaaaagagcgggaaaaagcggccgtcatattctcagcacacagcctgccggaaaaaatcagggagcatggcgatccttacccggatcagctcgagaaaacagcacaactaatcggagaacggctgtcatttgaccagatcgccgtaggctggcaaagcgagggcaacacgcccgatccttggctcggcccggacgtccaagacttaacaaaggaactgtatgaagaaggcttccggtcattcatttacgcaccagtcggttttgtatctgaccacctggaagttctgtatgacaacgactatgagtgcaaagtggttacggacgagcttggcgcaagctatcaccgtccgcctatgccgaacactgatccgcggttcatcgatacgcttgcttcagtcgtggagcgaacatacaacagcacagaacaggagaaagcggagctgtaaatcgagctccgctttttgctgcaatgttatgacgtgacaatatcccgcttttgaaaaacccaaaaggagacagccagaaaaagaataaaataaacagcaatcacagccgctgaaaatgaaagagtcatatcttgaataaacggctccccatcaatgtattgactgagatctgaatttgcaaagatcgtatacttggtccaatcaaattttgccgctaaaaattgagtaatcgcagaccctgtaaaaaagacgaacagcgaaagaccgacagagacgaccgcgcttcttaggatgaccgaaatcataaaggccagcgtggccagcacaataatattcaataaagcggctccatagtctaaggctaaaaacttcagcattgacatctttatcacttcgccgcttcgataggacaaatagtattggcttccctccaaacctagcagggcataccctaaaacaaacgcaaataaaagtgtcgcagcaaacataaatacagtgttgagcaagatcgacaagtatttccccaatagataatgccaacgcttgaccggtgttgcaatcgcaaatttaatagttcctttgctgtgctcaagcgcgatggagttcgctgccagcacgattgcaatcaacgcgattaatgttgtgatcggttttaactccttcagcatcgtccaaacattgtatttcgcagaaggcggcaaattatgctcaagccggtattgattgaccgcgatctcttcttttaaaaattggtatttgggaaccgctgggctcagctctctcatttctctttcatactgagcgttttgaacggttaattgctctttccagttacctgtctccttctccttttcgccattgctgaccatccatgcaacagcgattgtcatgacaagcagcaagcttaacacaatccaggtacttttcgtcaccatcagcctgtaaagttcatttttcaagaccctcatgccggtcaccccttattgatcaattccagaaagctttgttctatcgactgtttttcctgcttcatatgcagaactcttattttgttctccattaacagattaacgactttcataatgtcttcttccatgcaaaggacataaatctcatttttatcttccgtgagaccgcctgcatactggtactcattcaacaggtcagccgcttcatcggcgtggccgtttaatgtaagccgataacgaaccgtatcggtatcgcggtgattgctcttaatttgcaggagttctccgtttttcatgacgccgtattcatcacaaatcatctcaacctcagacagaagatgactcgaaatcaaaatcgttttgttgaaggttttcgccaagtactgaaggtgttcgcgcaaatcaatgattccctgaggatcaaggccgtttgtcggttcatcgagaatgagaaattccggatcatgcaagagcgcgacggcaaggcccaaacgctgtttcatgcctaatgaatacgttttaactggtttatgaatacttcctgtcaaatcaacaagctgaacgatctcttctatgcgctcctttgacacgtggctgtggaatccgccgagatatttaaggttttggtatcctgttaagtgctcataaaaggatgggttttcaacaacagaaccgactcgggctgccgcttcctcgtaattgcttttaactgaatagccgtcgatgcggatatctcctgatgtcggctttgccatcccgacaatcattttgataagtgttgtcttgccagcgccgtttggcccgagcagcccaaaaattgtacctggggcaatttgaaatgtgatattttggacaattggtctgccttttattcgtttacttacaccttcaaattcgacttgactcattttgtattcctcctttttggtatggcctgatctgtttcaatagaagagaaaaaaagagctgcgaaaccgccgtgaaccaaacaatcgaaccgataagaacggcaactgacttctccattgcaatgagggccgtcacaggaaaagaccatggaaagagaagccctaaaggggattgcgaaacgccgaaactcagcagtgaacaaatgaatacgataatgtttaatgaggtcttttccttactggtgaatttaagccataggaccgtacagatcagcggaaaggttgacaagagattgagaatgaagcccttcatccaagaaaaccaaggggcaggcccggggaaccccgatattaaaccgaaggcaagcgattcgatcacacagacggcatataatgcggctgcgaacagtccaataaacaaaaccttagcaaaaagcatggctgcgaaaggctgcggcgataagattcgattcagccacactcggtttttcagttcatccttatgcaaaaatactgtgaccgaagagacaagccagggataaatcgtgctgaataccaacagcaatgtaagatgccttaacgatgtccattcattccctcccgcaaacggggtgattcgttttgccataaaccctgtaaacactaaagatgcggtaagaatgaatatgctcgtcattgtaaaatcagagttcctgagtttgatccattccgctttgagcaaatttttcacggatcttttcctccccgctccttaagatccaacacatacagaccgctatataacccgccgaaataagataaactgccaggcctatatcgttcactgaatattcagtcaacaaaagccaagaaactccccacggcaaataaagtgttccactttgcataaaaaacggcgtcagcgtcatcaacagcacaaatagatattctgcctttaacgtcttcagaaaaaactggacggaagacatgatcaccgccagtatcgcaacagcggctaaacgctctggcgaaaacaaaacatccttttgaaacagcagactgactgccaaacagccgtaaagcaagaccagcgctgagacgatagttatcacggcgattccagtcagcacccaagtgaacaggcgaacgggataccgcaagataaaagcttgatgcatcatgcgtccaaataatcttctgcctgtaatataagtcagccaaaccgagacgacataaacagccattccctccatgctacggatttctttatttgccccgtttttataaaagagaagataattaagcaaaacggcgagcaccgtgatgatcataaccgtacatgcaaacgtctgaaatttcattctctttttcaccgcttcgggacagcttaaccaaaaataaactttaaacaatttcatttaaacgcccgctttctatggctagaaaacgatcaaacaattcgataaaagtttcgttccaatggcttgatgccatgatggtcccgtcataccgccttatgatgtctacaacgctttcctgcgcttttcggtcgagcccatttaaaggctcatccaatattaagatggaaggctgatgaaataaggccattgcgatcttcagcttttgcctcatgcctgttgaatagtactgtactttcgtgtcatcagccggattgataccgaaccgctctagttcagaatagatccggtcatcgtcatctattccgtgaagcaaggcatggactctcagattgtccgttccagtaaggtgctcatgaagcggcacttcgtcactgacatagccgatatgcccgacagcagcttccctgttttggataatcgattgaccgtaaatcaaaatttcgcccgcaaataaagacaagccggtaattgctttaagaaacgtcgattttcccgatccgttttctcctttgagcaaaacccggctccctttgtccacagcaaggctgacgttttcaagaagtttcctgtctcccgcccgcacctcaacatggttcatgacaattggaagctcaaccatggctacacccttgaacgaattcccaacaaaatgaagaatccaatgaaatacggcagcgaaaaagccagtgtgaccatgtttttataattggcgaacgacaaatcgacccatgaacttgtaaaaataacggcggatattccaagtgtaagcaaaaagaacatcacccgaaagaatttgttttgaatatatgccccgcgttcatcctttccgtcaaggctgattaaaataatgattccgataaaccccgcaaatcctgcgacagcaccaattgaattgatcatttctagcatcagcgatcatcctcctctagttggtattgaaatacctcgttgatgtccttctcaaataacgcggcaatgcgaaaccccattaacagggatggtttgtatttattcttttcaatggaaatcacagtttgtcttgttacacccaatagatcggcaagctgcttttgcgtccaccctttctctgctcgcagcacaggaatccggttggttaacaccccgctttgcttttcaatctcaatcaccctctttatttgcaaatcatttacatatatagagtacaatgttttttacacattgtaaagagtttataacaaaaagtaaaaagttttttaccaaaacagactaaaaaaagatcttcacgtgatgattgtgtgaagatcttttcgacaatcaagatttaggtttttcaaaaatcagttcgatagaagaaacctggcctccggcccttgatggaacagaaaagacgctgtgaagcttccagcctttttcagcatattcatgaatcacatcagaataatttttctcaagttttccgttgaatgctcctacagcgattgaaactgtttgatattcatacatacccttcactccttgttcatcattttcagcgcttgataagcgcgtacttccccgtagccgtatataacatctttccccggtttgcccaggtctaatgccgatttcctcaggatgtgatgcacttgtttagccgatggcttcctgtgatggcgctcccggtattcagatataaccagtgcagctgttccagctacctgcggggcggccaagcttgttccgtatgagagggaatatccctttgggatgtttagcatctggtctaatgcggtgttgtccttccctttcggatacgttgtcagtacgaggtctgtcacacgaaccatcccatcctgatcatacgtttctcccaaatatcctcccggggctgtgaattcaatttcccgcccttgattggagtatggggaaatattgttgcttttcatattgctgccgactgatacgacgtgcttcaaagcgctcggcaaatgcaccttgttttccgttttcctcatctcatcaaggttgactcctttattgccggcggaagagaagaccagcacctgatgctttgcagcgtagtttgcagccctttgataagctttcatcagcacttttccttccctgtcaagagaagtatagcttcccgtactgatgttgatgacttcatgcccgtcattgactgcatcaaccatcgccttcatgatgttgtagctgtctccgcctttttcgtccagcacttgataaggcgttatcgtcacatctggcgcaatgatattgatcatcccggctgtttgtgttccgtgtcctgtcggatctccggatacaggcttgccgtcaatgtaattccagccgccatttgtattgacggacgcttttaagtccggatggtcaagatccagtccgctgtcaatcaaggcaactttgacgtccggatgccctctttcgatttgatacgtgcgataggaatccgtctgctttgcagcgaaccatagatattcttttagttccaaaataccgtcaagcccccatgcaggcgaaccgctgatgactgattccgtttcgtttactgctgtatttgcaatcggcttttcaatgacgtcagccccgactttttcagcaagcttctttgtaaaaggagcaagcttttgtttttcaccggtcacttttgcaaatccgatttcttcaatgacatcggcatggatgtgaaattgttccgccgtgtccagcagtttcgatttatcttttacatgttcaagcaaaagatactgttctcctgcttgttcttttgcttgagccgtctttccgccgaccggcagcaggactgcaaaacataagagaaaaatatatattcttttcacatcatcacctctgcagattgctctttttcaaggaactttcgataaaaatctccgtaaaacttgctctcattcagcaatgtttcatgcgtacccacatttaaaaccatgccgtcttccaaaacgatgattttatcggcatccatgattgaagtcagtttatgcgcgatgacaattcttgtacatttcagctcccttaaaaaggcgtcgatttttttttcattttgatgatccagcgaactcgtcgcttcatccaacagcatcacagcggggcggtttagcagtgcacgggccaaggcaatccgctggcgctgccctcccgaaatattcatccccatttcagaaatcatcgtattaaagcccatcggcatattttgaatgtcatcgtatatttgcgccatttttgcgacttcatgtatccgctcaatgtcaacatcttcactgtataaagaaatgttgtctttaatgctgcggttgaacagcgttacatcttggggaacaacaccaatttgtttgcgaagagcgcttaaatccttgtttttaatattcacgccatcatagaacacactgccttttgtaggcatatagaggccaagaataagttttgccagcgtgctttttccggacccggattgtccgacgatagcgattttttcgccaggcttgatatgcaggcttacgtctttaataacttcttcgctgtgcgggctgtaacggaacgaaacccgttcaagccggatctcccccttaatcggggagttgtctttatttccaggtgtctcttcaatcgggctttgaaggatatcctgtatccgatgaagataagacgtcgtcaagattaccgagttgacggtttggacgatcgagctgcttgtattaaagaattgtgtggataaagcatgaaatgccaccagctccccaaccgataaattcccttcgaacacgagcattgcaccaatccataaaatcagcattggtgatatgatctgcatcgtgcctgtcagagagttcacgatgttaagaaacccttccttgcgtcggtatgccccgatcagttcccccagatagtgatcccatttttgatacgtttctttttcgattcccgcagtcttaataccaaaaatcccatataaaaactcagtctgatagctttgaatctgcgaagtctttgcgatttcgtcctggtttttttctctcagcttcccgcggctgagcgccgtgatcccgacattcagaagagccagcagaataaccagccctgctaaaggcggcgatttataaaacatataaaacgagataaataaaagtgcgccaaaatcgagtacgccgaggaccaattgggaagacatcatatccctgacaatccggaggcttgtcgcgcggaaaaggagatccccgaacgacctcaattgaaagaattgatagggaagcttcagaatatgcgagaaaaatgttctcatcattcgtttgtcaaggaagttatttaatttaatgataaattgacccctgatcaattgaaccgtgccttgaacgagcattaaaacaagaacgcccgtcataaatgtttgcagcagagcctgctgattttgagcaaggatgtcatcgatcaggtattgcacgagcatcggtatgcctaatgaaacgagctgaaagatcatcgcaaacaacagcacggtcgcaagcagagaaggggattcttttaaatgaaaaagaaaatgcctccagacgggcggttttttcttcggcctgatccgctcggtagggatcatctccagcacgatcccgctgtaattttcgagaaaagcttcgatactgagtttttttcgtccaatcgcaggatcgatgatgttgacatgccggtcttttatttgatcaataaccacataatgattatcggaccaaaaagcgattgccggcagacgcacatgtggaagttctgccgcgcctgccctgtacacctttgcgtcaaatcccagattttcgctgagctgacgcatatgaaaaagggtcataccgtccctgccgcatcccgataaatccctcagctcatgcagagtatgatgcgaaccataccgtccggctaccatcgccatacagcacagtccgcattccgtctgctgcatctgttctataaacggtgtcttatgaaaaaacaagccttatctcacctgcccgtcggaatatcgagagttaatacggatggaacagattcatcgaggagccgcaaaagcccgtaggctattcctgccgtcccgacaaacatgccaagcgattccacatcggaatgcaaacccgttttccatccccggtttttcgttttataaatgcaaaatatatcatcagggacatgaagttcccggttcagccttttgatatccagcagaatgttcaaattcccaattaaaccgtggcacagcgaatgattttgacagtctgctagatttaaagaactttgaagcgcttcttgaagctttaaagtccgggtagtcaattcaggaataaaagcctgaatgtgcgctctccccagcaaaatcccgggagctccatgacaccagtagcttggggacagcgtatgcgaatcatttcgtaaatctagccagtttagatgatccttttgaaaatagcggtcctcttcttcgacaagctttaggacaagctctttgcagctgtcatcgtgtatcaccttcgccgcctttgcgatagaaaatgcgatccccgtcaagccgtgtgaaaatcccgtcaacgaaacggcatcctgctcgattgaatcaagtaagcggccaattcgatcattcaatctgctcagtacctgtcttatagagtccaatactgctgggtgctgcttgatttcgtacagattaacaagcactgtcagcaatcctgaatcccctgcgataaaatccgggttttgtgtttgattcggctgatccaaaactcggggaatgaggttcaacgccctttccaataaggaatcgtcttcccatagactgccaagataggaatacaggtaaatgaatgagcctgtgccgaaaaaagcagaatgggaattcccattttgaacccaataactttcttccttttgaatttcttctatcattgatcttgccgtatccgtatatacctgctcgttcagtaccttgcctgcttgtgcaaaaaatattgccagccctgccattccgtcgtaaagccccataggaagcggcgacaaaaacaccattttttcgtctccggcattattgctgatccagaaaggaccttcaccgcgctctgaatagatcgccttctgcagcaaatcatcagctatatgcttgacctcttttccgagatcagcgaccgtttccttctgtccaagcccgctttctgcatggtcccagacattttcaatcaacgtcgccattgataaagaaatatagcggagctgatgattcaaatccttttccgagaaagattgaatttttttctttgccaaatcaatacttgatgtttcataaaaaccttccgattcttcccctcttgaattgagcagggaagtgcccccagcataaaaagtaaagtagggaatatcatgaagcagcagatcgacaatttcgtccggaataaacacgtttgccttttccgactgtttggcgagcatccacatataatcaaataattgctctcgtttatctccggcggtcaagtagtcagggtgggtgctcgcttcgagaaacttgccgtacacatgtgtcggccggaagacgtggcggacttcgtcgtgcttaaacagattcaaaaaccccgagggtcctgccagttcttctttatgtttcatcataatggcataagcatttttaaatccttccacgataaagtccgtatagaaaacggcggacaccggacgtccatttagtttgggcgcattcaatttttcctcggtggtcagcgatgtttcttttaaagacatcctgtcctcaccgtaattcaggacggcgtagcccttcgctttctttgactgctggccgcctttgccgccgatcccgcttaaatcaaaatcgagcacttcatcatgtttgaatttgaccggaagcatcatcgaagacagcacggaatgcttcagctccaatgcggtgacatggaggttttgattttgagcgaaaatgctgacatggttgtcaaaaagagtctccagatcaatcaggatggggtgttcgcctgaggcgatgatattttcattatgaaaatcgacggagcgcaatccgtacaatatcgccaaatgtccgccctgccggaaataaaatctttccagttcttcttctgaagaacagccttcatgctttacaaattcctgccagccgtaatttcccctgtcaagcacttccgcagcacggaggctgtacttcattccccgtccgttcagccagttcagcagctccctgtaatgttcgtcaattgacaaggaccgcggtttatacacgagctttccgttgtttaacaccagcactttgacactctgcccgtttttgtgggaatctcccaaatccccttcaaatccaaccaattcgggggaagcgatattaaattttttcgcaatcaggctgcggtcgcttaaaaatctcccaataatttcttcatgaatctcgagcaccctgagaaccttctcagccatcagcctgccaagcacagggtaaagctcgaaaaattcccggtaaatttcaggatcggaaatgtattgttcaacaaagtaaacatatcgctcttccggtgacgccccctttagccggccgtcttcccgggctacattcagctctgtgataagtgttctcgtcgccagcttatcaaggcattggtgaagttcagacatgatgccgtcttgatagccggcagcgtcgattatgccggatagaccgccttcctgcttctcaaattcagaaaaagctttcgacatccgttcttgtgcaaataaaagaaaaggaacaaagaaggtgacaaatgacatgtggggaagcgggtgttttaattcggaaaccgctttagggttgtatttcataatttcagacaaacaggcagcccattccggcattttgccttgcagctgcacaggctcattgggtgaatgttggacagaagaaaggtgaaaatccgtaggacgagacggagtttttccgttttccggaaaaaagccggacggatgttcttgaccttgaccgcctcgttcattgctgtaaagagctttatacagataaatttcgaattctttcatgctcattctcgtcatccctttggcgaagaaaaccatccctgcaactccgttgcaaggatggattcttttgaattttttatgattccctagcatcggcttgtacacttagttgttgggcataatgaagcagaaaccgttacaccggctgtgatgcaagtccaagaagaggttgtagcaggagttgtttcaggattgacgtcatttcctcctaccaaagctttcaattcctcttcggaaaccatccctgccggatgattggctcctttgaaggcttcacgggcagctgaatttttcattgttttcatgattctcacctcctagaacgggcaaactatcgaaattttcctataatttagaattgactcgccgttccagtcaaattatactataagtacatcaagaaatcgacaaaaaattataaattttctaggaggtggaatatatgtcaaaaaaggaaatgattctttcatggaaaaatcctatgtatcgcactgaatcttcttatcatccagcagggaacatccttaaagaactccaggaagaggaacagcacagcatcgccggaggcacaatcacgctcagcacttgtgccatcttgagcaagccgttaggaaataacggatacctgtgtacagtgacaaaagaatgcatgccaagctgtaactaagttcccaacgcgggggccctgctcccgcgttggcatattgatagaaaaagaggtcgatagaatgaatgaaaaatccgccggatatcacgaacggcttcccgtcgcccaaactcaatccccgctcgtaaacgataagataaagtattggcgttcccttttcggcgatgatgataaatggctcaataaagcagtttcattattaagccatgaccctttgtcctccatcgcacaatcctcggtatcccagtcagtcgggctgaaagacagccgtcgcggcccatggcagaagatgcaaaagcggatctttgaaacgcccttttcctacaaggattctgctctgcaagattcagaattgctgttcgactccctgctgacccgttttgcgtctgcagcacaagatgctttggaggaacaaaatatcatactttctcctcctctttgccggcaggtgctgacacatttaaaacagacgcttcttcaaattgcccatcaaacattaatactggaactaaacattttaaggcttgaagatcaattgaagggcgacacccccgaaatgcgctatcttgatttcaatgataactttttagtcaatccaggatacctgcggaccctgttcaacgagtatcccgtattgctgcgccttctgtgcacaaaaaccgattactgggttcaaaacttttctgaactgtggaagaggctgaggcaggaccgcgaacagctgcaggctgcatttcatattgccggcgatcctgtccatattgagcttggggtgggagactcgcacaataaaggaaagatggcagccatccttacatattccgatggaaaaaagattgtctataaaccgagaagccatgatgttgacgacgcatttcaacttcttctatcatggatcaatgaccgaaattcaggcagccctttaaaaactttgagattaatcaataaaaaacggtacggatggtccgagtttattcctcacgaaacgtgccatacgaaaaaagaactggaaggctactatacacgcctcggcaaacttttggccgttttatacagcatcgatgccgttgactttcaccacgaaaacattatcgcctccggcgagcatcctgttttaatcgatcttgaatcaatttttcatcaatataaaaaacgagacgaacccggctcgaccgccgttgacaaagcaaactacattctttccagatccgtacggtctaccggaatcctgccgttcaacctttacttcggaaggaaaaaccgggataaagttgtggacatcagcggaatgggggggcaggaagctcaggaatcaccgtttcaggcgcttcaaatcaaaggatttttccgcgatgacattcgcctggagcatgaccgatttgaaatcggcgaggcgaaaaatctgccgactttagatcaccagcatgtccctgtcgcagattatcttcattgtatcatcgaaggattttcagcagtataccgtctgatttctgatcatggcgaaagctacctggctacgattgaacattttaaaaactgcaccgttcgaaatattttgaagccgacagcgcactacgcctctcttttgaataaaagctaccaccctgattttctcagggatgcggtagaccgtgaagtgtttttatgccgggtggaaaagtttgaagatgcagacacagatattgcagcggcaaaaacagagctgaaagagctcattcggggagacatcccctattttctgtcgaagccttcagatacctatttgctcaatggcgaagaagaaccgattgccgcttattttgaaacgccgtccttcacaagagtaattaagaagatctcatcattttcagaccaggacttaaaggaacaagcgaatgtcatacgcatgtcgattctggctgcatataacgcgagacatgaaaaagacgcaatcgatatagaccaaaatcacccgagtcctagatcaggcgccttgcagccgctcgccatcgctgagaaagcggctgacgatttggctgaaaagcgaattgaaggcaatgatggaaaggacgtcacttggatcagtacagttattgaaggcgtcgaagaaatctcttggacgatctcccctgtcagtcttgatttatataatggcaatgcaggcatcggactttttatgagctatctgagccgcttcgcaaaacggccggagacttactcgcatataaccgagcagtgtgtatttgcgattcagcgagcgttgaatgaactgaaggaaaaagaagaattcctgaagtacgccgactctggggcattcacgggggtttccggctatctgtattttctgcagcatgcgggaacggttcagaaaaaaaacgaatggatcgaactcatacatgaagctctgccagtccttgaagctgtcatcgaacaagacgaaaactgcgatatcatcagcggttctgccggtgctctaatggttctgatgtcattgtatgaacaactggatgacccggtttttctaaagctcgccgaaaagtgcgccggccatttgcttcagcataaaacaaatattgaaaacggagcggcctggaaagatcctcatacacaaaactattacacaggatttgcccacggcacttccggcatcgccgcagctttatcccgattcaataaagtgtttgattcgcaatcactgaaaaaaatcatttcgcaatgcctggcatttgaaaagcagctgtacatcgcttccgaaaaaaattggggatcaaaaggaagagaacaactgtcagttgcatggtgccatggcgctgccggcatattgttgtcgagaagcatcctccgagaaaacggagtcaatgatcccgggctgcataccgacatcttgaacgctcttgaaacaactgttaagcatgggctcggcaataaccgctcattctgtcacggcgatttcggccaactcgaaatcctaagagggttcagggaagaattcagcgaactgaacaccattatacagaatacggaagatcggctgttgacatattttcaagaaaatccattcagtaaaggggtatcacgaggtgtggattcagccgggctcatgcttggtttaagcggagtcggctacggcatgctgcaatgccaatatggagaagaactgccggaactgcttcagctcagtccgcctcaagcgcttatcaaaaagaacagcaaagcttttaaaagagaaaacgtgttttaaaatcaaaatctatggattttcatccatagattttttttgcaacattacgatgaaagaccttcatccaaatgcgcttattctcagattcgtgtcatttggcataatcaccagcttatgagcaaatccaactcacaacatgattattcagacaattcagaaatatatgctatgctctctctgattccaataaaagggagggatgatcggtgcccaccattcagtatccgccgtaattgtaagcgcttcccattcagcgttggcatcaaaaaagaaacaataggaggaatataatgaagaaattaatcagcatcatctttatctttgtattaggggttgtcgggtcattgacagcggcggtttcggcagaagcagcttctgccttaaactcgggcaaagtaaatccgcttgccgacttcagcttaaaaggctttgccgcactaaacggcggaacaacgggcggagaaggcggtcagacggtaaccgtaacaacgggagatcagctgattgcggcattaaaaaataagaatgcaaatacgcctttaaaaatttatgtcaacggcaccattacaacatcaaatacatccgcatcaaagattgacgtcaaagacgtgtcaaacgtatcgattgtcggatcagggaccaaaggggaactcaaagggatcggcatcaaaatatggcgggccaacaacatcatcatccgcaacttgaaaattcacgaggtcgcctcaggcgataaagacgcgatcggcattgaaggcccttctaaaaacatttgggttgatcataatgagctttaccacagcctgaacgttgacaaagattactatgacggattatttgacgtcaaaagagatgcggaatatattacattctcttggaactatgtgcacgatggatggaaatcaatgctgatgggttcatcggacagcgataattacaacaggacgattacattccatcataactggtttgagaatctgaattcgcgtgtgccgtcattccgtttcggagaaggccatatttacaacaactatttcaataaaatcatcgacagcggaattaattcgaggatgggcgcgcgcatcagaattgagaacaacctctttgaaaacgccaaagatccgattgtctcttggtacagcagttcaccgggctattggcatgtatccaacaacaaatttgtaaactctaggggcagtatgccgactacctctactacaacctataatccgccatacagctactcactcgacaatgtcgacaatgtaaaatcaatcgtcaagcaaaatgccggagtcggcaaaatcaatccataagctttgaggtgaaacgtccggggcattccgggcgtttcacttatttccatcctcatacgctttccataccgttggcagcagatcggaaagttcatgcgcaagaagcgcatgagccgatctggtctttgtccatgcgtccgcacatgcgccgtgcaagtggacagcattcagcaccgcttctctcgaattctcatgacagcacagcatcccgagaagcatacctgttaacgtatcccccgttcctccctttgccagcgccccatttcccgttacattcctccagcactcgccgtcggggaaagcaacgatcgtttcattgcctttcaagacaagggtaataccttgttcctccgcataatctcgagcataaccggcccggtttgcttcaatttctcgaatggacaagcctgtcattttcgaaaattcgcccggatgcggcgttaataccaccggcgcttcccgttcatgatacgatcgttttgaaagagcacccgcatcaagcacaaccgggcagtctttcgctaatacgctttgaaccgcttgctcagtcatttgcgaaggcggcagcccaggcccgatcgcaatcgcccggtaaggttcggcaatctcgcctgacgccgccttttcggcgccgtcccgccaatacgtcgcctcaggaagaacggggaggatcagcggaatcgcactcccgcacgttccgatgacaagctttcctagaccgctccgcatcgccccgattcctgcaaggagagccgctcccggcatatcatcgcttcccgcgagcaaaaggccggttccataagttcctttatgactatcatttccccttttcggcaatgagcccttcacgcagtctttcgtccatatcggcaattgttctgcagacatcccggatcacacctttcaatatagtttaaacaaacgtttaattaaattgtaactgaatcatacccttcactgctctttaacatgcaaaatagcactgatgaacggatcagtttacgttcatataaaaaagacagcttcacaacttgaagctgtgcttggcgttttcgactaaaaaagccggctgacaggcgcatccagacgataaagtcttgaatagcgcggattgttttccaaaagctgctgatggctccctgccattgcaagcttccctttgtctaaaaacagaatccggtcggccgcttcggctcctgccaaatggtgtgtaatccatagaacggtctttccatcaagtacttgaaacatcgttgaaagaagctccttctctgttttaggatcaaggcctacggtcggttcgtccaacacgacgatgggtgcgtcctgcagcagaatccgcgccaaagcaatccgctggcgttctccacctgaaaaacggatgcccgtttcctgtacagatgtatgatatccatcgggaagagactgaatataatcgtgaagcttcacctggcgcgccgcccaatacacgtcctcatcgctcgcgtcagggttcccgagccggatattattcaaaaccgtcgtatcaaacaggtgcggctgctgattgaaaacggagactacgcgtgaaatttctccctgaagagactgcacagaaatatcgttcaatgtaatgtttcctttagaaggagcaagcgccccttgtatcaacgacaagatggtcgatttacccgcaccgctcgggcctagcaaagcggtcttttcaccctgctttaatataaatgaaacaccgtccaacaccggctggccttgctcataagaaaaagaaacgtcttcaaagcgaagcgtgacatcgtccaaacctacagcctccgcccgttcctgctgaacatcggccccgttcccccttttcggcggctgcagaccgtccattctttctaaagaatcctgatactcagggattgaagccgctgcgtccgaaagcggaaagaaagcttccgtcaaaggaaacacaacaaggacaaacgccgcaataaacacaggagccagagccccttccgcgctttggccgcccgcccatattagcatcagaagaacaagtcctgccgccaggcattgcatggcaaagtccctccaacgactgaagcgcacctgtttcttttcgatcgccagccattcatgttctgccgcttcatacgaatggacaaagtcgttttgccggccgctgaaaacccaatcgctcacccccatgaccgcgtctgtcagctgacggtacaagtggctccgtcctcttttcagcgcaacattttttgcccttgtcacaagcagggaaacaagcggaacaagaaatacgaaaaccgcggcatagaccgccattagtccagcaaaaggccatgaaaaaaagccgatagctgcgatgaatacgccatataaaagaagagccgacagcccgggaaataccgttctcaaatacatgtcctgcaaatgttcaacatcgtcggccaaaatgccgagcatatcccccgttcggaaacgttcacgccattttaaagcttgaggttcgagcatcctgtaaagcctgacgcgcatatcggataaaattttcaaaatgatatggtgccctgtcaaccgctcaacatagcgcgacaccgagcgcagaatcccgaaggtgcgaaccgctacgatcggaacatagatcatcaaaacattttccggacgcgtagccgctttggatattaaataaccggaggtaaacatgagagcagccgccgagcatgccgtcaacccgccaagcagcacgacaatgatcaaaagccttgtatttttcttgatgtagggcagaatccacccgtcttcattgttcatgatgcacctccaaacgactgcgccttcacgagctcgtaataaacgccccgcttttcaatcagttcttgatgtgtaccggtttcagccacctgcccatctttcagcacgataatttcatccatatcaagcatccagtgaaggcgatgggttgccaaaaaaaccagcttgtcttcaaacagttttaacatcgtttttttcaactcgtattctgtttcgatatccaaatgagcagtgggctcatctaaaagaataatcggacggttgccaaggaaagcccgggcaacggctgtacgctgcgcctgtccaccgcttaatgccctcccgccttcaccgatccgctctttcaagccgtttggaagctgatcaatcagctccgagagcccggcagctcttgctgcctgttcaacgtcttcgtcagaagcggcgggatgataaaaacggatattggctgcgagcgtatccggaaagatatagggatgctgcggaatatacaagagctgattttgccagctgtccgtctgcaaatgcgttctcttttttcccccgactttgataacgccgcttttcgtttccaggaagccgccgagcacatcgataagcgtagattttccggcaccgctttccccgatgattccgatttttctctttcccttaaatgaaagagaaatcccggataaagagcagttttcctcatcttcatgccgcacatctacatgcttgaactcgatttgatcgtcgtcagaccatcgctcaagacttaaaggcgcctcatccttgaaacccggcgaatccaatatcgccttgatcgctttaccggcttcgcgtccgttcaatgtagcatgatagtcattgccgacttcccggacagggagaaaaaactcaggggcaagaatcagaatggcaagagccggctccagcgagatgctgccgtcaacaagaccgagaccgagaaaaacagcaacggtcgctacggacagcatggtgaaaaaatcaagtgcaaacgatgacagaaaggcgatcttaagcgtactcatcgtcgccttcctgtaccgttcgctcacatgaaatatattcttagtatgtgaacggctgatgcccagcactttcaatgtttccaggccgcgcaaggaatctgtaaaatggtttgaaagcatctcatacgttttccattggctgtccgcttttcttttagccgcatacccaagaaggatcataaaagtgattaaaatcggcatcgtaatcattaagactgcagcggaagatgtgtctttaaaaaagacataacagacaaccgccggcggtataacggccatgctgaccattttcggcaaaaacagctccaaatagcggcggaactgtgcaattccttccatcgcgagcgtgacgacatgaccggttccttctttcctcgccagcctggggccggattggaaaagcttctccaaaaactttttccgcatgccggcccccgtctcggcggcatagtcaaatatcagcttttgcctgacaagggtaacagcatgtcgaaataaaaaagcggcggtaaataagatgagcagcggaaagagcgaaccgacgcgttctccgttaaaaaggcgggtaaccgcttcagcaagccattcggcctgcatgataatggcggcgccctgcatgcatgtcaggacagtgagtactgcaagtattcgtttcatccctttatattgcaaaagatcttttcccattaataaatcattggctccttgctgctgacccgttttctaaaaacatagtagctccagatctgatagcccagcacgaacggaagcagtgccagcgcgacgatcgtcataacctttaaagaatagtcgcctgatgaagcattataaacggttaagtcatatgcgcttttcaccgagctgatcatgacgcgcgggaacagcgcagtgaaaatcgtcgccactgtaagagcgatccctgcgcccgtcatggcaaatgtccagccgtcgcgtttttgtttcataaacacgatcgacagcacatagcaaacgacaatcagagccgcaagcggtatcgtcacatgccccctgcccgtgaacaagtccgtttcaaaaatggataatgcaacaaaggcaacaagcgccgccaaaacggcgaatacgacttttttggccagctgtcttgcccggtcgcgcaaatcggcttccgttctcaatgtaataaagatcaggccgtgcagcaggcagagaagcgtaacggcgactccccctgtcacggaatagacgttcacataatcggtaaaaccggcgtgcagattcatatcggcatcaatcggcatgccgcgcaggatgctcgcaaacaatacaccgaacaaaaacggcggcagaatgctgccgaaaaatacgacccaatcccatgtattcttccattttgcggtttcgacttttcctctaaattcaaacgcgaccccgcggccgatcaatgcaagaagaacaaagacaaacggaatgtaatatccgctgaacatcgtggcataccagttcggaaaagcggcgaaaatcgcgcctcccccggtcagcagccagacttcatttgcatcccagaaaggaccgatcgtattgatcatcaccctccgttcaagatcgttgcgcccgagaaaccgcgtcgccattccgacgccgaaatcaaagccctcaagaaagaaaaaaccgatgaacagcacagcgactaatataaaccaaaattcattaagagataccatggtaaacctcctgatcaaacgggtctgtcgatacggaatcatcatgatggtggtcatggtgtgcagccccttttttaatctcccgcacaaacaagtagacaagaacgagcgccagcacaagataaatcgctgtaaacgcgatgacagagaacagcagcattcccgctgatacgttcggcgacacggactgcgccgttgtcaaaataccgaacaccgtccacggctggcgtccgatttcagtcatgatccaccccgccgtatttgcaatgaatggaaaggcgatcaaagccaccattgtccgcaagaaccatttgcttgtttcgagtcttttgcggaagctgagataaagaccggtcaaagcggcaacgatcattaaaagtcctgatccggccatgattctgaaactccagaatgtcgttttcaccggcggaatataatttccttctccgtatttttcttcatattgcttttgcagtgtcttcattccgggcacatcgccgctgaattgtttataagccaaatagctgagcgcatacgggatgctgagctcggatttgttttcctgcttgtccgtgtcaatgttcgcaagcaccgtccatgcagccggatcgccgctgtcatcccaaagcgcttcgctggcagccattttcatcggctggctcttcatcagatgctgtgcctgctcatgtccgctgaacgcaacgccgcccccggaaacaagcgccacaatcatcgcgatttgaaaggattttttaaaaaagagcaattcctgttttttcagcattttatacgcgctgacaccggcaatgaaaaacgccccagtggcaagcgcaccgaaaatgacgtgcggaaattcaacccatagctgcgggtttttaataatcgcaaaaaaatcggtcatttccgcgcgtccgtttttgatcgcaaatccgacaggctcctgcataaacgagttggccgctagaatccaaaacgccgacatgatcgtgccaagcgaaacaagccaaatggacagcaaatgaatcttcttcggaaggcggtcccagccgaagatccacaaaccgataaacgtcgattccataaagaaagcgagcagcgcttccaccgcgagcggagcgccgaatacatcaccgacaaagcgggagtactccgaccagttcattccgaactgaaattcttgtaaaatcccggtgacaacaccgactgcaaaattaattaaaaataagtgcccccaaaatttagccatcgttctgtaaatgtcttttttctttgcgacataaagggtttccattaaagcaaccataaagacaagcccgattgacatcggtacaaaaataaagtgaaagatcgttgttgaagcaaattgaaatcttgccaaaatgagttcgtccactgttcctgtctcctcctctttgttctagccgggcccgtttgccaaatgggcatcacacttgctcagactttcacatgcatcttattaatgtgattatgattacagacaaaagggtgacctcggcccgcattgatgttccgttattatcatgatggttatttatacctgtactttaccgcgaattccttcttaaataaagtacattttccctaatttatggatgtcattgtgacaattatacgaaggaattatagatattttgtgacacgctggttaacaagcactaaaacaacatgagaaaaatgccccgaaattcacgtggaacatttcgtcattcaacatctgtgattcttcgcgaaagcctgtcgcatcaaaagaaaaccgttatatgcagtgaaacaaattcggggttttccttcagtgtgagcgcgccttacggaaagttctgctgttttgtccaatctgtgaaatcttccttccgccttctgcgcattcccttcatccatttgctgatttatctccactgaagccttcacgcagcacgagctgactgcaccgcacgtttttccccctgcacagccatccagctcccgctgactattaacggaggaagggaaggaatatttattgctttgaaataaacaataacgataccccgtttattctatgaaaatcgaaccatacatttgttcaaacaaaatacacaaaatttgtgaaatgtttcacaatatcctgctatacttaggttgtatttatgatagatacttcttaagtaaacacttgatggtggtggaaaacatggaatctaaatcacttgttctagtcgaagagcttgctttaaaaaagcaaagcatctttgtgcaaagcccgcttcgctatcttttacgggctatgctggccagtatgtttatcgggttcggagtcattgtagcgtttaaaacggggaatctcttttatgttgaacattctccgttcacatatccaattgcagcaatcacctttgggggcgccattattctgatcgtctatggcggaggagatttatttacgggaaatacattttattatacattggctgcgcttcgtaaaaaaatgcgctggcccactgtgatcaagctgtggatgttcagctatgcaggaaatttaatgggcgccgtttttttcgcaggcctcatctttgcgaccggcttatttaaagatccttcttccaccggctttattctcagcgtggcggagcataaaatgaatacgccggtgaccgaattgttctttaaagcgattctgtgtaactggcttgtctgccttgcgtttttcgttccgatggcgcaaaaaggggacggagcgaaaatgttctctatgatgctgtttgtctttactttctttatttccggttatgaacacagcatcgcgaacatggccacttttgccgtctctctggtcaccgagcatccggagaccatttcgattgcaggcgcaatccataacctaattccggtaacactcgggaacctggtcggaggcgcgtttatgatgggcttcatgtaccactatgccaacaagccgggcggtgaagaaatcatcaaataaaaagatcgtccatttttaatggattctaaatatgcgggctcccttcataaaatcgtggtaactttaaaaatggaggttcagcgatgcaaagttttcattcgctttgccggcaatttggacatattttaaatggggagccgcacattgaaccacggtgtctgttctgtcagcatcaaacggaatttgcgtgtcgcgattcaaggaagaccgagccggggagtcggcatggaagaaatcatgttcgaatcgctcgatcaaaacggaatcgccttgaatatggccgaagtcgcaattttgcctgaagaagttccgctgtttacaaaaaagcttgtcgatcagggcatcattatcagtgctctccacaatcattggatttttacagaaccgaatattttatatattcattttcaatctgtagaaccgccgttaacattcgcgaaaaaaacagctgccgctttatccgtattgcgatgaagcagcagctgttttctttatccgttgatttttcccatttctgaaagtgcgaccctttcgactgctttggccacaatctcgtgaacttcagggttcagcggatgaggcacaagatcgccttgtcttgtgcaggatgcgatcgcttcagcggccgcaaccagcatcgggtggctgatcgaatcggctccggcatttaacacgcccctgaaaatacctgggaaccccagcacattgttgacagaccgtccgtctgcagcgtaggctgccccggcctcgagcgcatcctcaggctcaatctccggcttcggattggacagagccaaaatcacctggccttcccgaacccatttcttattgatcaatcccggaacaccggttgtcgcaacgacgatatcgcagctttccatcaattcttcgatgctttcagccgcatggccgccatagttctctaaacgcgccatcgcctcaagcgatttatccgttccgacaacacgttttactccatatgccataaacatcctgcagatcgcgacacccgccgcgcccaggccgatttggccgacatgggcctgcttcagatccacccctgcactcttggctgctgaaatggcggccgccagcgtcacaaccgccgtaccgtgctggtcgtcatgcatgaccggaatattcaggtcgtttttcaggcgctcttcaatttcaaaacaatgcggtgaaccgatgtcttcaagcaaaatgccgctaaagccgggcgcgatgtttttaaccgtccttacgatttcatcaggatcattcgtgtcgagcagaatcggaaccccgctgatatccgcaagctggtcgaaaagagcggctttcccttccataacaggcattccagcaactggccctatgtctcccaagccaaggatggccgtgccgtccgttacaattgcaaccgaattgccgattccggtataaatattcgctttttgcggctcttctttaatgagctcgcacacgttcgcgacacccggcgtatacacccgacgcagatcagcaagcgagcgaatcggcatcttgcttttcatgcggattttgccgccttcatgtgcagccagcacgtcatctgaaacggtatgaagatggatgccttcttttaagttgcggatcacttcaagaatctcggtgagctgttcttcatgctcaacttgaaccgtaatgttccgcatcgtataattcggccctaccttgatcgtttcaatctctccgatatcaccgccggcaaggccgatcgccgttgtcacctttccaaggtttccgggtgctgaagggatttccagcatcaaattccgaataatattgttgccattcataacagaatacctccatcaattgttttaaaatcggctactgaaccggcgagtcttttttatcggtgtaccaaataaatttacctgtgtatccgtacaaaatcgcaaggccgattgaaacaaagctcagccacatgaacggcacataagagaaggtcgagacgccgagaatccccgccatatatatgccgttgtccgaccacggcaccatgcccgacgtcatcgtaccgccgacttccgcgtttctggacagcaccctccggtcaattccgagcttgtcatagcttttttccataattttcggtgttaaaatgagcgagacatacatcgcgcagccgaacacatttgccaagaaggcgacgataatcgtcgagaatgtgacgttgccggcagaagtcagcttttgctggaacttggagacgatcacttttagaacgcctaagtgctccaagaggccgccaaagcccagaccgagaatgatgacgacgaccgaaccgagcatgccctctattcctccgcgatttaagagctcgtccataaatttgatcccggtgtcaatggaaaagccgttgtatgctgtgccgatcgcatccgcaaagtccatgccttggaagaccgcagcccagatcgcgcccaaaagtgcgccgatcgcgatcgtcggcacagatggctttctcatcgccaatagaacgatgacgacaacagccggaacaagcatccaaatgtgaatatcaaacgtgttctgcaaagaagctttcaaaaattcaactttttccaaatcaacatttcggcttccatacataaagccggtgatggtgaacaggaccgccgtgattaaataggcgggaatcgacaagtacagcatcgctctgacatgggtaatcacttcgacctttgaaagggatgacgcaagcaccgtactatcggaaagcggcgataatttatctccaaagtaggctccggacagcacggctccggctacaagcggaagcggaagccccagcccttccccgattgccatcatggcgatcccggccgttcctacagtcccccaagacgtacctgtggcaacagatgtgatcgaacaaataatgagcgtggcaagcaggaatatgctcgggtggataaactcaagcccgtaataaatcaaagtcggcacaacaccgccggctatccatgtgccgataagagcgccgacggcaatcaggatcaatatcgcttcaagtccatttgaaattccgtttgtaatcgatttttgcaaatcttcataccggtgccccaggcgcagtccgagcaaaatcaccaagaaccatgaaataaacaatgccagctgaatcggcagctcgaatttgactgtaaatgaacaaactatcgctaaaaatgcacctaatacacaaatgatttccaacattgatggcaaccgtgctgttttcaacctaaatcccccttaattattgaaacgctttcaaaataaactacataaaaatagcaatctgcttcaattttttcttaaaaatttaactaacaacgaacagtataccatgaaaaaggctgatgcggtaccacttcaccgctgttgtcctttctcttcataaagttattgaaggaaagcgaaaacactctgtgtttctatcccggtaaaatgtcagagtgttttcgcatactgttttttccagatcaatcccgatttaaaagttcagccccggcaatccccggttttgtcatttcataaggattcaaaatcagatcaagctcttcttctgtcaacacatcgttttgaagacagagatcgcggacggattggcctgttaaaatggcttctctcgcaatccttgcagctgcttcgtagccaagatgcggattgaccgcagtgatgacgccggcgctcttttcgacatatgcttttaagcgtttttcattcgcttcaatacctgctacacagtgatcagtgaacgaacggaatccgttgttcatgatgctgatggattgcaggagattaaagacgagcactggctccatcacattcagttcgagctgtccggcttcagaagcaaggcagatcgtatgatcgtttccgatgacctggaaggcgatttggttgatcagctcggccataaccggattgactttccccggcataatggatgaacccggctgtcttgccggaagggaaatctccgcaagtcctgcgcgcggacctgatgccatcaaccgaaggtcgttggcgattttcgacatgttcatcatgcatacttttaatgcagctgaaacttctgtgtaagcgtccgtattttgcgtcgcatctaccagatggtcagcgccgacaagcggaagaccgctgatctcagccaagtgcttgacgacattttcgatatagcgcggatccgcgtttaatcccgttccaaccgcggtagcgcccatattgacttcatacaaatgctggcgcgattgtttaatccgtttgatgtcgcgttcgatcacgcggctgtaggcttcaaactcctgtccaaggcggatcggcacggcgtcttgaagatgggtgcgccccattttaatgacgtggtcaaagtcgcgtgcttttttcttaaaggcatcaagcatgtattccattgtgtccagcagcttttccagcagcttaagcgttgaaatatgaatcgccgtcgggaatacgtcgtttgtcgattgagacatgttgacgtgcgtattcggactcaggtgaatatattcgcctttgttgtggccgagcagttcaagtgcgcggtttccgatgacttcgttcgcgttcatattcattgaagtgcctgcgccgccttggatcggatcaacgatgaactgatcgtgcagctttccttcaaggatctcatcagcggcttggacgatggcatctccaaggcctttataaagacgttttgtctccatgttggcaagcgccgccgcttttttcaccactgccagcgccttgatcatttcttcgtggattttatatcctgtaatcgggaagttctccgctgcccgcaatgtctgaatcccgtagtagacatcggccggaatcttcttctctccgagaaaatccttttccgtccggtatgtcatttcagctttcattttttaaccctgctttctttttatatgatgatatcgtctgcaatcggcgtttccatgatctttttgacttcagcttgttgtccgtttttccctaaagcccacatcagcttcggaacgatcgcttcagtgttcatatttctcgagcggataatggcatcctggtttaccttgcggccgacctcgtaaatgctcatatcctctccttcttcaaggcattgcgtcgtgatcgctacgaccataccggaatcgatcagctcgttcactttttctaaaatgtttcttttctcaaaaggaatgccgccgcttccgtagctctcaatcacaatgcctttatatgaacctttcagacaatcgaaaaactctggttttaaacccggatgaagcttcaccagacaaacgtcggtatttaaagaggtatcgagtttcaaagcgcctggctttacttcgggaacccgtttgttgtactcgatttccttatcgtgaatgaaagcgatgtaaggataattgatgctttcaaatgcatcgtagctttttgttcttaatttgatcgctctcgtgcctaaaatgacgcggccgtcaaagacgacatatactccgccgatgccgtcgcacgcaaagcggaccgcatcttttatattttttttcgcatccgttttcttaaacgtaatcggaacttgggaacccgtaatcgcgacgggcttatcaatattctgcagcatgtatgaaagcgccgctgaggtgtaggccatcgtatcggttccgtgcgtgatcacaaagccgtcgtagcggctgtaattttcatatacagcctcagccatcatcacccagtgttcaggctgcatgttggtgctgtctatatccattaaagattggcaatctatcgtataatttgaatgatcatcagataaatagctgagaagctcttccgctttaacccccggagccagtccgttttcgccttctactgaagcgatggtcccgccggtggtcaacagcagtaactttttcatgtgctacacctctttaagaagtagttttatacagtataaatcatgatttattttagcaaagaagacttgatacatcaggaatgtatacgctttatgcgtaccttcaatgcaattatagtcctcaaatgtgaaataatcaagaaactttattcatttcgcgtacacttttactgataatgtgctataatcactgtgtatcaaaaggagcgtaagatatgaatttagatcgattaacaacactgagaaaaaacaaaaaatggtcattgcaatatactgccgaccgcctcggtattgcgaaaagcacttacgcgggctatgaatcgggataccgccgcccttctttagaggcgcttatcgaaatcgctgatttattcaatacctccaccgattttttgctcggaagagttgacgatccccgggatgaaaaggctaaaaacgaagccattgaactgacggattgggctaagctcaagctggcagtcgacggaacgcttctttccgaagaagaaatcaagcagatggttgcgtttatcaaggtcaaaaaagggctggatgcggagtaaaatgacagcggttaaccgccgcatgctataaaaagaaaaaacttgactggctaaaaaggccaatcaagttttttttgcttttattgatgtaaaaatttcacacaaaccgcttcaggagcaggaactccagactctaaaagcgtcagccggcccgttgtccggtctctttcaaacaatgtcaaagtccctgtttcctggttggaagcaactaagaattgctctgaaggatcaatctcaaagtcgcgcggccattccccttcagttgatacgtgttcaaccagggaaagttcgcccgaatactcgttgacgctgaagacggcgatgctgtcgtggccgcggtttgaagcgtatacaaatttgccgtctttcgtgatgtggatggcgccgccttggctatggccgtcaaagccttccggcaatgccgaaatcacttgaatctctctgaattcacccaaatcggggttgtattccagcacgatgacttcattactcagctctgttaatacatacgcatacttttcctgtggatggaactcgatatgtctcggccctgagcccggtgcagcagcgtgttttttcacttcttcaagccggccctctttcaattgatacgtgatgatatgatccgttccgagatcgacggccactgcatatttctcatcaggtgagaatcctgaataatgagtatgcgctttttcctgcctctcatgcggtcctgatccctcatgctgtacttttgatgaaggctcaagcaggccgcggctttcatttaaaggatatgccaagatcgtcccgttgtggtaattggcggacagaacataacggttatcttgatccacactgacgtggcaaggcgacggtccttccccggtctgctggttgacgatagtcagctctcctgtggaaccgtcaatacgatatgcggcaaccccgcccttatcgccgtctttgaccactgcataaagcatgtcattgtctttggcgatattcaaatatgtcggactgcccagctttgctgccggcttcggcgtgcttaacgcctttttttccgtatcaagctcaaatgtataaatccctacgctgtctgcttttgtatatgttccgatataacctctgtatttcgccatttgatcctctccttttttgacagtcgtccattcctattttaactcagagaaactgaattatcatgatctggtatgcaaaaaccttaagcgctcacatgaaaaaaaactttttatgatattcttaacattagaggcccttcactgccgcttttataaagaaatcggcagcggagacttgttcataggagtgttcaaaatgacgaaaatcatgattgtcgaggacagcgaagacattcggaagcttttacgcgatcatttagaaaaatacggatacgaaactgttgcagcgactgatttcacctctatccttgaaatatttctccaagagaagcccgacctggcattgcttgacatcaatctgccggcatacgacggttactactggtgcaggcaaatccgccagcattcgacttgtccgatcattttcatttcggcgagaagcggagaaatggatcaggtcatggcgatcgaaaacggcggcgatgattatatagagaagcctttttcctatgaggtggtctcgctaaaattaaaggccaaattcgcagggcatttggagaatacgcagtaaaacaaggtgaaaaagtgattgaatttgaaggcgtccagctgtttgtcgaacgttttgagctgcactgccgaaatgagaagctcgagctttcaaaaaaggaaagcaagctcttggaagtgctgcttgaaagaggagaaaaggtgacaagcagagaccggttaatggagaagacatgggaaaccgatacatttgtagatgaaaacacgctaaatgtctatattacaaggattcgcaaaaaactgcgaagcatggacgtgcccttctcaattgaatctgtgcggggcgaagggtatcagctgaggacgaaatcatgaagctgttcctaaaaaaccatgccgttctcatttttctgtttctctttcagggcggattcgtatttttttactattggtttgccggcatgcagactttcacccaccttttttacattctcggcgttcagcttctggcgcttgcgctttatctttcatacaaatggtatgaagaacacagagtctaccaatggatcggctcagatcaaaaagatacagaaattccttttttggggacgtctgaattttgctcagagctctatgaaaaacatatggagctgagccggctccaccaccgcaaaatacatgatatggagtccaagctggaagatagggtaacctacatgaatcaatgggtgcatcaggtgaaaacaccgctttccgtcatcaatctgatcatccaggaagaggacgaacccgtttttaaacaaatcaaaaaagaagtccagcagattgaatacggactggagacgctcctctattcatcaaggcttgacctgtttgaaagagattttaaaattgaggccgtgtcactagacgagctgcttaattcgctgattcagcgctataaacgctattttatacagcatcgtgtctatccaaataaacaggttcccgctgaagacgccgttatttactccgatcgcaaatggctcagattttccactggccaagtcatcactaacgctgtgaagtactcgtcaggaagaagcgaacgcatcgatttgacgatattccgtaaaggcgaacgcatcattctggaaatcaaagattacggaatcggaatcccttcacaagatgtgaaacgcgtatttgagccttattacaccggggaaaacggacggcgctttcaggaatcaacaggcatcggcctctaccttgtaaaagagattgccgaaaagctcaatcatgatgtgagcatcgattcagaagaaggaaaagaaacgactgtgcaattttcatttcttacaaaaatgtaagtcttctttaataaaaccgcatagctcatccccatcctccttgatatgatttgtttacaaaacaaacgtggcaaggaggattttttataagcaatccgagtctatgaaaagagtcggcacattctgttatataaacgaggccgccgttcttagtttctggacaatggccattcaagcctttcataaacgcattttggctgaaagcattccggaggagcccgctggaatggataacataccggaaacggtcatccttaaaaagcgcagcaaaaggaggatatcatgacaacaaatatgctggtcgttaaaaacatcaataaaacatataaaggacaagtctcccatcaggctttaaaagatatttcattcaatgtcgaggaaagtgagttcacggcgatcatggggccgtccggttctggaaaaacgacgcttctcaatatcatttcgacgattgaccgcccggattccggcgacattttaattcgcggagaagacccgcatcatttaaaaagggcgaagcttgcccactttcgccgcaggcagctcgggttcgtattccaggattttaatttgctggatacactgacgatcggcgaaaacatcatgctgccgttaacgcttgaaaatcaaccgctttccgtcatggaagataaacttcaggcgattgctgaaaaactcggcattgaacaacttttgaacaaacggacgtttgaagtatccggcggacaaaagcagcgggcggccatcgcaagagccgtcattcatcagcccgccctcatcctcgccgacgaaccgacaggaaacctcgattcgcaggcatcaaaagacgtgatggagacgatgcagcatcttaatgaaaacgacaatgccacgatattaatggtcacgcacgacccagttgccgcaagctattgccgtcgcgtcatttttattaaagacggaacattattcaatgaaatttaccgcggcgccaaccgccaagtattttatgaagagattctgaatgtgctgtctatgctgggaggaaataccaatgacctttcttcagttcgcttataaaaacgtcgtccggaataaaagagcctatctcgccttctttttaagcagctcattttcagtgatgatttttttcacatttgcgatgtttttgttccaccccgctttagaggaaggctacttaaacaccattgcaaaacgggggttgtcggtggctgaatggatgattttcgccttttccattctgtttgtgctttattccgtcaacgcctttctcaagtcgagaagcaaggaattcgggatcctcaccatccagggaatcgctccgggtcaattgaggaagctgattaccgcagaaaacatcatcatcggcgtgctttcgatcgttacaggcatcatcggcggtcttgtttttgcaaaaacattctttacgatcggcgcttatattctggaaatggacgctttgccattgtatctgccttggaaagcgatggcccttacatccgcctgctttcttgcgctgtttattctgctgtcgcaatttacggtgttatttattaaatcaaaaaccgttgtcaagctgatcaaaggcaccgggaaaattaaaccggagccaaaaccgtccattattttttcggtcgtcggcatcggctgcctcggctccggctactggcttgtattgttcgccgacatccattttccccaagccgtcacgatcttaattttgacgatcatcgggacttatttcttcttcagccaaagcagcatttggctgctgcggctgttaaaaaagcggaggtcattttatttacgaggaaaaaacgtgctttggatatccgatcttgtttatcggctgaaggataatgcccgcctgttctttctcgtttgcatcatttccgcggtcgcctttaccgccatgggtgcattggtaatttccaagacttctatcggaaaattggattcccgatatgagatagagtacttattatacagcgggagccaaaaggaacaaacacacgttaaggtgatcgaacaaaaattgaaggacggacatttttcgtatgcaaaggaagtgacaaaaggaatttatatgagctatagccagggagatctccttcctccggtgctcctggtctctgaaggcgaattccaaaagcacttcaagttaaattccggtgaactgaaagacggtgaggcgctgtattatccaaacgcctttgaggcaaaagaaaagcgggaaattcctgagaccttggacatgttgaacaaagatttgaagccggcaaatgaacggctaaaggtaaaaggtattaaaaaaccgctcatttcgttagaaagcatcgttgtcgtaaacggcaaaaccttcgaaaagctgaaaaaacaaggcgaatccctcacattgtacggctatcagtacaaccgctggaaagagagcctcgacatgagccaatcattggaaaaagatctcagagaaaaatctcacaatatccaatttcaatttgaagcaaaggccatcaattattttgaaactgttcagcttccaagcctgagtctgtttatcggattctttttgaagcaaaggccatcaattattttgaaactgttcagcttccaagcctgagtctgtttatcggattctttattgcggttctcttttttacggcatccgggagctttctgtacttccgcctgtttaccgatcttgaagaagatcaagagcgctaccggtcactctcaaaaatcggcctgagcgaaaaggaaatgtcgcagagcgtaacgattcaattggccatcctgttcttctttccgttcgtactcgcctcaattcatacgtattttgcgatgaagacgctcgaggcacagagccttggtcatttcgcatctccggtgatcatgacaataggcggatttctgatcttccaactattattctttatgatgattcgaaaaagctatctgaaaaaattaaaaggatttttaaggtgataaaatatgaaaaaaacaatttctctcattacagccgctttagctgtatgtatcggcgcatttctgttgattcataatgaagtgacagacaggttcaatccacttgtgaagaaagaaagcgtatatgtccagatcaacaaagacggtaagcacctgagcccgggccgctatgagtacacgctggaaggatataatgacaccggtaaggaaaaagaaattacattctccgccagcgattcccttcgaagaaacgcctatctaaaggtaaacgcgaagggaaaatatgttgagacatgggaagaagtacagcccggcggcatgccgagtgccgttcagaaaaaattgatcaagcaataaaaaacggcgtctaagccgttttttctatgaatcactatattttaacaaaattccgaaactttttggcccgttgctcgtataaaaacagaagtcatattgtttaggaggttttcatatgattgttggaataattggttttatactggtggttttccttctctacgcctccatgttgccgtccggggaaaaaaacagcggcagcagctcttcgactttttttattggaggtcctgactcatccggagacagcgggggtgattgcggcggcggcggcgatggcggctgttaagacctgcggctgcgttaacctaacttctgctcctgctcggatccctaggctgtatgcagttcttgctgcagtgagccgggtatattccagctatctcccttcatcattcattcaacatcaactccaaatacgtcattattcattcagttgtttaacctgacttccgattgggaatgatgtaaagacagcagattcccgctcttcaaacgatttaaaagtcacaataaagcgattctgatacaaaacatataaaactttgcacctacttgttcgatattaaaagaagacattcatgataaggagggttttttccagatgatttttttactggttttattggctctgtttattttgtattcattcttttttgacaagaacaacaaaagttcttataaaaaagcggcaccgaaaagcagaatattgatccgccaggcagctgcgccgaccggagttttgagggtaatcgaaaccgctcccggacagacggcaaaccgccgaacctccgaaggtatgcgcccgaatctgcggcttgtcatgagcccgacgcaccaaaacgaaaaaaaataaggaaagcggcatcatgataaatgccgtctttcctattgtctgctgtgttccaccattttcccaaaggcgtccggcgacatccccggcgagattcggacgcggtggagcgcatacatcccctgatccctagatgccgctcccggttctgttgtgacggccatttgatagcctgcctgctttgcgagtttcagcgtatcttcgttgtagcgcccgaccggatagctcagcatcaccgtattttggctgaacatgcgatcaaacagcgctttggaacgcgtcatttcatcgagctgctgtcccggtgccagtccgttcaattcaacgtgatgaatggtatggctttgaatcgaaatgccgtttcgcctcatttcattcatttgtttctccgtcaaatggttcttcccgccaaccgatttgccgatcataaaaattgtcgccttcatcccatagcctttcaaaatcgggtacgctttttcaaagttatctgtataaccgtcatcaaacgtaatcagcacgcatttatcactcggcattttatcttgcgttaagacaatataggcttcctcaggtgtcaacgtgtaatagccgttatccttcagccacttcatatgcccgcggaattccccttccggtacgcgcaggctgtttcctgaggaaatgctgtgatacatgagaatcggaatgcgggccgggcttttcactttgacccacttggatgatggatcatgttccgcctgctgttttgattgttttgccgctttttgagccgtatttggttctgttttttcctctccttttgtttcatgaccggaacacccgtacagcacccccatcaacatagacagcacaagtaacattttcgtttttttcacaattattcccgctttctatctactgaatcctttttaatatcggtgcggaacgggcatttttcactgttcctgctttgaggaggagagccaagctttacgcagtctgctgatcccttcttcaatttccgctgcagtaagacccccaaatcccgccatgacgattgaagagctgctttcatgaggcttaatccagaaatcggataccggataaactttcacaccgagtttttccgctttatgtatgaggtcttgtgcatgtcggtctgtcttcatcaaaatatggagccccgctttttcgccgatgattccacgtcatttccgaaatgcgttttaatggccgatattaatgttttgtgcttttcttgatatacttttttcattttacggatgtgcctttcgaaaaacccttctttcctaaataaaaacatcgctttttgaatgatgggtgaagcagactggctgtagcggccaagcttctcttgaaattcatccgccagttttgaaggcagaacgatataactcaatctcgctcccggaagaaatgactttgaaaaagtccctaaataaatgacattttcttttttatcaagcgcttttaaagatggaataggcctgccctgatagcggaattcgctgtcatagtcgtcttcgataatataggccttctcacggcttgcccattcaagcaatttcagcctcttctgtatcggcagaaccattccatacggaaactgatgcgatggcgtaatataaacgagtttcgcccgtgttgcagcaagctgtgtcaaattgatcccatccgtctccagaccaattggctgaatatcacatccatggttaaggaaaacagaacgcacaccatcatatcccggattttccaacgcaaccaatcggccgttcattgagagcagctggcaaagaagtccgactgcatactgcgtaccggaacagatcacaatttgctcaggtgcacagcggacacctctttgttcagccccgagagatcacagctaaagaaaacatgctgaaccaaagcatgaaattcgaatacgggcggaccgtacaggaagaccattgacaaaaaaagacccgcagcttatgctaccgggtctcccattgattttgatgcatgttcatctaaaaatttcaatcccgctgtgtatcgctttctccgcttctttatccagcagacgagcgccagccgctgatccgggtccttctcattgatagaaaccagcacatgttcattgatttcaagcgggaagccggattcaatctgacagcctgacaagctgatatccttaatcataacctcgtgagcccctttctctgaatcacggggaaacagcagtgttcccagaccttgaaaggcctcgcgcacgtattttctcttgaatgcatcagggcttttttcagttttcgttaaaaagcgtatcactgttgacaacgtatcagcccgcttttcccggtcggccttttttgcattttcttcattaaacataaaaccgatcagtttcacatacagttccttgtccatctctttgaagtgcagcccgatttcaatgtcggcctcgtccttcgtcgtccacatcacccgggccgggacttttccgaccgcatctatgatcagaccgtctacatgatagtacatatccgaatcagccgtataaggcagtctgatacgcgcgcccgtgtcgctcacatcgatcagttcacatttgtgctcatctactgaaacggtggaaaaagccgccggcttgttgactgtgaaacgctcagagcttcggaacctcggcctgtcaaaggcaacgagcagcgcaagtatgagccctgtcatgttatagagaacccaaaataaattatacgaagtgacgtttatatcaaacgtatgaagaaacaacaattcataaagggtttttccgagtgcaagcagcgtcattgcgagcaaaatcgcacacggcagcgccgttgtatatttgaattttcgccgatctgtgttgacgcctttcggtgtgactttaaaatcaaaccgctttttgaaaatgaattccgacaaggccgatatcgccatgtgcggcgccatcgatgtatcgtaaatatggctccagttcatactgcgctgccggtccgaaacggctttaaatgaaaggtaagaacctaaaaacgcaggcagccaaaacgaagtgatcgaccacagatcagtctttaagctatgtatgccaaacagcaaaaacatgagcggcgcgaggatgtataccatcttaaaaacgccgaaaaaccaaaagagaatgccgtcaaaataaaggattcgctgcatgggcgtcaagccttttaagaaaagcggattccacttctttccgcactgaatgtttcccctgcaccagcggtcgcgctgtttcaaaagatccatccacgtttccggcgagagaccgaccgcaagcacttctttgacgaaaacagatttaaattttgtttgcaaaagcatccctgttgccatatcctccgtaatcacacctgtcgcaaaaccgccgatttcctccaaagccgttcttctgaaaaccgtattgctgccgacgtacatgacagcattaaaacggtctttcccagcctggagcctgcgcatgaaaaagtcctgctcattcggaatgttcgctccggaaaataagttgtactgataaggatcttcattatagaaagcctgcggcgtttgaacaaaagccactttttccttcttaaaatagccgacggttttctgcaaaaatgaagggagcggaaccatatcggcatccatcgtcacaatcagttccccgtttgagcagctcatcgcatggtttaaattccccgcttttgcatgctcattgttttgccttgtaacgtaatgaacgccaagttcctcagccagcttttgaatagccgtccgccttccgtcatcacacaaataaatgttgacaagctcttttggatagtcgaggttcagacagcctgccaccgactttttcagcacatggcgctcctcgttataagttgcaatgagaatatcaacgctcggccgatggtcttgatcgcccagcttttccggctcccgcttcttttccttccatactagcgtataaaagaccaagagctgtaaaaagccgatacattcagttgcaatcaggatgacgcccatcacgatatcggcggggcgagagacgggcagcgtaaagccgaaccgccatacaatatacacaccgttcgtcataagacacagtatgattaaaaacttcttaaaacgcgaattcacccgcgatccccaaaaaccgatgagaatcagagcaatcattgccgcgggatagtagtgtaaaataaattccattttcttctccttatgtgatacataaaaaaacctttttacagggtttctctaaaatattcctttatttctttcttttgcactcaaatatattaccactatttgtcctaattttctttaaaaaattataaaaattatatctttttatctattaaaaactgaaattatacgactatagtctcttgttcaaaaaaatcataaggctcacattgataacccttcacatgtaccccgtatcaagattgaatcttttgtctcagacgtcctgtgtcttttcagagaaaggagctgaatgtatcaacgctttacaaaagaaaaaaggtctctgctcctaaatgtttgatttatttttgacggattaacagctattttgtgtcgatttttattccataaaaagggaatccaggaataattgcatcaaaaacggcctgcacaagggccattacctatatccagacacgtctttagccaaatggagctgttcttgatcattatgggaaaacagttaggtcttcctgcacggttgtctgaattttgatttttttagtatacttaatttagttaaataactcagcaaggggatcacataaaggatgggggaaagaatatggaagcaaaaacaaaggtacaacatataccgattcaaacaacaaaagaacaggatgaaaatttttttgcaagagcaatgaatgttaaaatcggcatcattccgctgcccgtatatttgctgctcttcgctttgattgtgacgtttgtctatatgcacgatctgaaaagcgacattttaacagccattgcggttacgggctttttcggattcaccttcgcccaaatcggaaagtcgctgccgcttcttcgttctgtcggcggtgccgctatacttgcgacgtttattccttcagctatcgtctattaccatctcattcccgatgacattatcaaatcaacaactgaatttacagaaaactcaaactttctttatttgttcatctctgccattgtagtcggaagcattttaggaatgaaaagagaaacgctggtcagggcgttcattaaaatttttattcctctgattgcagggaccattgctgcagcggcagtcggtctggcggtcggtacaatgctcggcctcggatttcagcatacgctgctgtacattgtaattccgatcatggccggaggggttggcgagggagctattccgctgtccatcggctattcggaaatcatgcacatgtcacaaggggaagcttttgcacttgtcattccttccataatgttcggaagcttaagcgccgtcattttgtccggaattttaaatgtaatcgggaagaaaaagcctgaattgacaggcaacggaaaagttgaccgttttgatagcggggacgcacagccgctcgaaagccgcgacaaagacaaagaaagcctttttaatctttcccactttgcgtcaggaggcattctcgccgtctcattatatttggtcggtatgctttcacatgacttgttcggatttccagcacccgtcatgatgcttctgctggctgttgccctgaaactgtttcgtctggctccggcgaatttggaaaacggcgcctacggcgtgtcgcgcttcttttcaactgctgtgacatatccgctgctttttgccattggcgtctccatgacaccgtgggacaagctgatcgcagcttttaatatcgccaatattattacgatcgtatccgtcgtggtcacgatgatagccgtcggcttttttgcagggaagtggctgaatatgtacccgatcgaaaccgcgatcatcaatgcttgccattccggccagggaggcaccggcgacatcgcaattctcagcgccgcagagcgcctcgagcttatgccgtttgcccaggtgtccacaagaatcggcggagcgataaccgttacgctgacgctgctgctgctagcccagttttattgatgaatgaaaaagcctgcagagcgagctgcaggctttcttattgtggctaccgtacttttttcggaacatagtcgggaaagtctgtcacaatcccgtccacgccggcctttaatagcggaggcacttcatcgcgggagcggacggtccaaggcgtaatcttcatgccgagcgcatgaattctcggcacaagcgtaggatcagcggccacatttttcaagttggcgttcacgtatttggcatagccggaaaattccttaagctttgcatctgttaagtccgccgcttttgacgtcaagacacctgtcggcatcgatggaagcagctgatgaattttatagacagagttaaaatcaaacgattgtacaatgatttttccgtttttaggcttatccattctccgctctttcaatgctgctgacacttttccttcgattcccggatagcgtgcaggctctttcaattcgatcagcattccgaccttccctttataccggtcaagcacttcttcaaatgtcggaatgcgctctcctgcgaactgcggaccgaagaagctgccggcatcaagcttgcgcagctcggcaagcgtcaaatcctttacggcaaccggcagcactgagtcaatatctgtcgtacggtttacggtcgtatcgtgaatgatgacaagctccccgtctttggacatttgaacatccagctcgatataatctgctttcatctgaagcgctttatcaaaagcagccatcgtgttttccggcgcatatcccgaagcgcctctgtgtgcaatgacatccacttttttaggcttcaccgccggctcttgtgcacccgcattcggtgcaaacagcgctgacccgatggaaaccccgatcaatgaagataacatcaattttttgaataaagctgacacatcatccactccccttttgctcttctcttgccaaagtataggttcgcactgttaagattatgtttcagcagtctttaattttcataaatttcctgataaacaaaaaaagatcccttggcagagatctttttttggatatatcagcgctcacaggcaattttgtctttatcgcggtccagcttcttattggcatcataaagcgcttttgaaacatacggcttgtacttcgtttttccgcctttgtttttcaccgatttcgtacgggcgacgccgcctttatagtctttgtttaaagctttgcagtttttgtacgtctttaccttcgtttttgcttctgccacatcgccggcgccccaggaaaaaccgatgatcagaccggcagacaaaagacccgctgctatttttttcatcccatttgacccctttcgtctatttgttatgtatcttttaccatgataaaatatttttcttattcgatcaagaaaaatatggcattttattgaataaaaagtatgaatcgaaaaagcgtctcttcgcacaaaaaccggccgttatgcgccggtttcatccacatattgatgttcgcaagtctttttcaaaacagcgttaatctcatacgctaattccttcggatggatgcacagcatgtcttccaaagggctgtcccagttcccgttctttatcaatttcagcgcataatggcctgccggactgcactcgggataccactctacatcgagcagaaggcgttcttcatcatgccgcagcttcaaaaggtcccgtttgaagtcagacagccaagccttgctgtcaggcgctagttcatcggggtttgtatcagttaaagagtgatgcgcaactgtccagccggccgggattctaagccttagcaaattgcgggcgccatcagaggcacgcatcaagtcttccaaccgttcgatcagctgttcatacggcgcgtcagaatcttcgctgaccttcgattgatcagcattttgcatcctgatgacgtacttcagttctccagcatattcaacttgtaccattttaccgcagctttcattctccaagatcaatagcgtatggcgggggtcgcgaatcggcttttgatacaaatgattttccttcaccttccagccggccggcaccatcaaaggatgcaatttaaagaaatactgagatttggtcaacgctctcacatcctctttcattgttctgtcttctttcctatcaatctatgtgccggacaggcttcttagaacaacggcggagcggccccacaaaaaaaccgcctgacgcttgttaaagcagtcaggcggttttttgtcttttattctccggttttttcttttccgtaatgatattttgatggatcaacaggcttgaagtctgaaatctcgtggaatctcaacagatctttatagagtacttggtcggacagatccagctgttcggacacctgcgatttcaggttttccgtctcttggttgcccttgatctcttttcctgtctttgtatcatatacggtcgtatcaatcatcgtgtacttcggcgttacatagtttccatttctgaaagccacggtttggtcgtggtctttagaaaagaggtctgtaccaaagttgatgtattttttgctgtcaataccttgcaggtgaagaagtgtcggcatgacatccatttcaccgccatacgtatggttgactccgccttttttgcccggaatgcggatcataagcggtacgcgctgattcatcgcgttttgatacggtgtaatctctttacctaatacttctttcatcgcacggttgtgattctctgagattccgttgtggtcaccatagatcactataacagaatcatcaaataatcccgcttttttcagctctttaaagaaatcttcaagcgcttcgtcaagatagcgcgccgtctggaagtaaccgtctaccgttttgtctcccgttgttcccttttcaagggtggcatcctcttcatccaaaatgaacggatagtggtttgtcaacgagattaaatgcgcatagaacggctgcttgagcgatttcagcttcggaattgattcttcaaagaacggcttgtctttcaagccaaggttgacgagattatcctctgacatatcatatgtgctggcgtcaaagaatttgtcatagccaatttgtttatacacctggtcgcggttccagaatgacttgtagtccccgtgcagcacggcgcttgtgtagccttctttttggttcagaatcgccggcagggactggtacgtattttgcccttttgttacaaacgcactgccttcaggaagtccgtaaaggctgttgtccatcatcaattcggcatccgctgttttaccttggccggtctgatggaaaaagttatcgaaatacatcatgtcatcctggccgtgcgccagcttgttcaagaacggcgtgacttcttttccgttcagcttataatcgatcaaaaacgtctggaagctttccaaatgaatcttgatgatgttcttaccttttgctgcgccgaaatactcgttattcggtttcgcataatgcgaatttgtatagttgatgacgctcgtcaggtcgtcgctgctcgcgtatgccttttggctcgcgttttgagcggcctgaacaccatcatagatcatgtaattgtaaggccccaaatacttgacgatgtaatttcggtcaaatgttcttgtcaaaagctccggacggtctgtctcggcaactgcaaggttgatgaaaaacagagccactccgccgagaacaacggcagcagcccatctttttttcagttgtgacgccttcagttcaggcagcttcacacatagagcaatcaaaatgatcaaatctgcgaaatagacgatgtcatgaaatgccatgatgtcaaaaacgccgtcagacatattgccgaggtttccggcttgttttaagtttgcaaacgtcaaaaagtcatcaaagaaacggtaaaacaggacatttgcatataaagcaaacgtcatcacagcatcaatgatgatgatccatatcgccgaccggcggccttttgcaaacaaagccaaaccgagtgcagcaatcgtgaagctcaatgggttgatgaacagcagcatgtgctgcgtagaccctttcacacctaaattaaactctaaaaagtaggaagcataggttttagcccatacaaaaacaacagctaatacaaaaaagcttagcttatgagagaatatttttttcatgataacctctacctttttaaacttttttcagaccgctttctgtttcagtcaatgaagcgtgaggaaacgataatatatcattctactaaaagtctcggcggttttacaagcacgtcctggtgaaatcccccggcttccctcactcaaacagtctacgcctgcgaaaaaaattttccgcatgtaagacaacggcctttaattaagacgaatgaatttccccaaaggtttcagttattttctttcatctagaaaattgcagtttcccggacgattaaatatctttatgaaattcatttaaataagcctttctttgcgcttctgtaaactgaccgatccattccgcacgcgcttcctccgtcatatacggcaggatgtacagctcgaccgctttataaaattccggctcaggcagaatgttgtacgtcggaatccgcaccctgccgttcccccgtgtctctatcagtatatccatcaagaaaatgcctttcgggctgtagcggtgctccgccattttaaggcttttgatgtccttgaacaacacagatttcttccctgagaatatccgcccgtcttctccctcgataatggtgaagatgatgtttccttttttcgtgaaggccggaaaaaccattagaaaggtcatcaaaccgtagatgaccccgaaagttccaactcccacgtacagcaaggaatattttgattcgagttttattgcttcataaaagagccatgctccaatcaatccgaaacctgcagtccctgcaaaaacccatactctaaaggacattctgcttttcacatcaaatgtctgctttttttcctgttccaaaaataattaggccctcctctacttcagcaagcggattccgctacaaataatattcatgccaagacctaccttaccacagaaaccagttcctgcataaaacttcatgtatttgtctgtccctaatcagaatgaatacagaaaaggctcccggccatctgccggcagccttcccctattttgaaatatcaacaaatccctcgccgaatacatccctgacatcgtggatgatgacaaatgcttttttatctgtgcttctaataattttcttcagcatggacagctcttgtttattaatgacaatgtataaaatttctttggagtcgcccgtatagtgcccgcgtcccgataatatcgtgacgccgcggtccatcagggtattgacctgcgccgcgatctcgtttttatgctcggaaataatcgtgatcgcctttttcgtgttgagcccttcgataatgaagtccatgaccttcgtggcgatgtacagcatgacaatcgtaaacatcagcttttcagctccaatgataaagtaggaactgaagacgacaactaaatcgatcatcagcaaggcatagctgatgttccagtcaaaatatttattggcgattctcgcgagaatcgcagacccggcggtggttccgccgacacggatgatcatgccgattccgacgccggcaaataccccggcaaagatggtgctgatgatcacttcatcggccggcaccgtccaatcttcggtgacgtgcagaaagaacgaattggccgccaccgcaataatagtgtaaatcgtcgtctttttatccaaaaagcgatagccgataatcagaagaatgccgttcagtacaaagtttgtgatgcccggagaccattcaaaaacgtagtataaaatcagcgtgatccccgtgacgccgccttctcccaagtcattcgggatggcgaacagattcacggctaacgcaaagaaaaatgcgcctataatgatcaatattatgtccattgctttctttttcataaatacatccccttcctttgtccttaatcgatttcctgtaaaaagtaaaaaagcccaggagagaagctctttgattaagagcaaaaactcctgggcttttatcccaccgtgtcataacgatacttcgctatgtgttttctctcggaccagaccagcgcgggagggcactgcggaaccctagaaaaccaccttttctctgctatcaatttgtcatcttcaagcattataagtgaaattctggggtctatcaacccctatatcagcctgaaagatttgtttttttgtaaaatagcttccatctgtcagcgataaaaccattctataataatagatatacgtgttttgcctgggaggcgctcttatgaacaaacaaaaacggcaatggctcatcaagcagaccattctcgaacatccggtagaaaatcaggaacagctggcatccctgctggaaaaacgcggcatcaccgtttcgcagtctaccatttcccgcgatattaaagaaatgtatcttgtgaaacagcccggtgaaaacggaaaacttgtctacacgacaaatgcttctttatccatcaatccttccaaaatattaaaagataaaatctctgacgttgtcctgcatgtgcatcgaacggacaacttgatcattattaaaacaatgcccggcaacgcccatgccatcggcgttcttcttgataagctcggaagcccggaaatgctgggctgtatatgcgggaacgatacatgccttgtgatttcccagtcacctgaggcagcccaatcattttatgaccatttatgctgatccggccgtccggatcagctttttttgcccttcaaaaaaatttttttcgagaaatccccgttaaaaatatacacgttttatacgttctattctccgctccgacaggaacttattttccatttatcataattattcatttttgtttttgcttcatcaaaaaacatgtgaaatatatcacgtttttgttgttatcgctttcacatcgcgcttttccttcctgttttaagctgtacatgtaacaaaaagagcttaggaggcgggatgatcatgacaacaccgatacacgtttactcagaaatcggccctttaaaaaccgttatgctgaagcggcccggtcgggaactggaaaacctcacacccgaatatctggaaaggcttctctttgacgatattccctttttgccagcagtgcaaaaagagcatgaccaatttgcagaaacattaaagcaacagggggctgaagttctttatttagaaaagctgacggccgaagctttggatgacgcattagtccgcgagcagtttatcgatgagcttttaacggaaagcaaagcggatatcaacggcgcatacgacaggctgaaagagtttttgcttacctttgacgccgattcaatggttgaacaggtgatgagcggcattcgaaaaaatgagcttgaacgcgaaaaaaaatcgcatcttcatgagctgatggaagaccattatccattttatctcgatccgatgccgaacctttatttcacaagagatccggcggccgccatcggcagcggactgaccatcaacaaaatgaaggagcctgcccgccgaagggaatcgctgtttatgcgctacattatcaatcaccacccgcgttttaaaggacacgagattccggtttggctcgaccgtgatttcaaattcaatatcgaaggcggagatgagcttgtcttaaatgaagaaaccgttgcgatcggggtatcggaacggacaacggctcaggcgatcgagcgtcttgtccggaacttgtttcagcggcagagccggattcgccgtgtactggccgtcgaaataccaaagagcagagcctttatgcatttagataccgtcttcacgatggttgaccgagatcaattcacgatccatcccgccatccaggggcctgaaggagacatgcggatcttcgttcttgaaagaggaaaaacggcagacgagattcatacaactgaagaacacaatttgccggaagtgctgaagagaacgctcggcctttcagatgtcaacttgatcttctgcggcggcggagacgaaattgcttcagccagggagcaatggaatgacggctccaatacactcgcgatcgctccgggggttgtcgtcacctatgaccggaattacatttctaacgaatgtttgagagaacagggcattaaggtaatcgaaatcccgagcggggagctttcaagaggacgcggcggcccgcgctgcatgagcatgccgctctaccgagaagatgtgaaataaccaacctaaagaaaaaggagagagatccatgaaccaaacgattaatttaaaaggcagaagctacttagctgaaaaagatttttcagaagaagaaatcctctatttgctcgatctggcccagaaactaaaagaaaaaaaagcacaaggcatcaggcatcgctatttggaaggcaaaaacatcgctttgctgtttgaaaagccttctacaagaacgcgctgcgcttttacgacagcctgtatcgacctcggtgcgcatcccgaatatttgggcaaagacgacattcagctcggcaaaaaagagtcgatcgaagacacggccaaagttctcggccgcatgttcgacggaattgaattccgcggatttgaacacgaaaaagtgatctcactggcagagcattccggtgtgccggtatggaacgggctgaccgatttatggcatccgacgcagatgcttgcggactttatgactgtgaaagaacatacgggacgcgtaaaaggcgtcaagctcacctatatcggcgacggccggaacaatgtcgccaacagcctgctcatcggcggcgcaaaagtcggcatggacgtaagaatctgttcgcctcaagagcttttccctgatcaggacatagttaaaatggcggaagcgttcgctgaagaatccggcggaaaaatcaccgttacaagcgatacagataaagccgtgtccggagccgacgttctgtatacggacgtctgggtatccatgggggaagaagacaagtttgcagaaagaatcaaactgctcaagccttatcaagtgaatatggatctcgtcaagaaaacaggcaacgacaacgtcatcttcctgcactgtctgcctgccttccacgaccttcatacaacctacggacaaaatgtttacgaacagcacggccttaaagaaatggaagtgacggacgaagtgttccgcagcaaacactctaaagtgttcgatgaagctgaaaaccgcatgcacacgattaaagctgtcatggcagcgacgctcggcgatcttgactgacaggaaaagggactcattcccttttccattctaaaccgaatgaggtgacaaaaatggcggaagaaaaaaaacttgggctgtttgcgctcatcgcgcttgtcatcggatcgatgatcggcgggggcgccttcaaccttgcaagcgacatggcttcaggggcgggggcgggagccattttaatcggctggatcatcaccggagtcggcatgattgccctggcattctctttccaaaacttgacgacgaaaaggcctgatttagacggcggtattttcacttatgcccgggaaggattcggccatttcatgggctttaacagcggctgggggtactggttcgcagcccttctcggcaatgtcgcatatggaacgctgctgttcagcgcaatcggatatttcatccctgcgtttggagacggacaaaacatcgcatcaattatcggtgcaagcgtgatcctctggtgcgtgcactttttgatcctccgcggtgttcagtccgctgccatgatcaacttaattacgaccatttcaaaacttgtaccgattttcgctttcattatcgccattatctttgtgtttcatcttgatttatttacgaacgatttctggggaaaagggctgtcgctcggttccatcggaacacaggtcaagagcacgatgctggtgaccgtctgggtgtttaccggaattgaaggggccgtcttattttcaagccgggccaagaaatcaagcgatgttggcaaagctactgtcatcggcttgatcagcgtactcgtgatttacgtcatgattacgatgctgtcgctcggcgtcatgaatcagcaaaacttggccgagcttccgaatccttcaatggccgcgatcatggagcatatcgtcggcaaatggggagccgtgctcatcaacctgggattgatcatttccgtattgggcgcctggctggcctggacattattcgcgggcgaactcccgctgatcgcggcacgcgaaggggtcttcccgaaatggttcggcaaagaaaataaaaacggtgcgccgacaaatgcgctgactttgacaaacgccattatccagctgtttttgctgacgtttctcatttcagatgcggcctaccagtttgcattttccttggcttcctcggccatcttgatcccgtatctgttttccgggctttatcagcttaaatacagctggctgcacaaagagcctaaccggggcaaaaatctcatcatcggcatcatcgcaagcatatacggcgtctggctcgtatatgccgcgggacttgattacctgcttttgaccatgattttatacgctcccggcattctcgtattccgggctgtgcgcaaaggaaaagaaggcccagtcttcaataaagccgagcttttgattgccgccctgattcttgtattggccgtgatcgccgtgatcagactggcttcgggaagcatttcaatttaacaaaacagaggtgattattaaatgaaaaaaagaaaaattgtcgtcgcacttggcggtaatgccattcaaaccggagatgccagcgcagaagcgcaaaagcgcgcgcttgaagaaaccgccatgtatttggcggatatgatcgacagcggcgctgaattaatcatcacgcacggaaacggcccgcaggtcggaaacctgatgatccagcaaaaggaggcggattctccgaaaacgccggccatgccgcttgaaacctgtgtttcgatgacccagggaatgatcggctattggctgcaaaatgcccttgaccgggcgcttcacgcaaaagggaaaggcggacatgcggcaaccgtcatcacccgcgtcgccgttcgaagcgatgatgaagcgttccgcaacccgacaaagccgatcggtccattttacagcgaagaagaagcgaaagaactgatgaacagccgaaacggcggcctcgtttttaaagaagatgccggaagaggctggcgccgcgtcgtaccgtctccggccccggtatcgattcttgaacacgatgttatcaatgatcttgtcgaacacggacatatcgtcattgcagccggcggcggaggcgttcccgtcatcgaaaacggcgatgccgtctccggtattgacgccgtcatcgacaaagactttgcagcctgcaaactggcggagcttgtgcaggctgacgaactggtcattctaacaggtgtcgactatgttgccgtcgattatttaaagccgacagaacgtgcgctgaaacgcgtcaccaccgaagaactgaaaggttatataaaagaaaagcaatttgcagaaggaagcatgctgccaaaagtcaaagcagccattcagtttgctgaagctaaaaaaggcaacaaaacggtcatcacatccctgaaattagccaaagacgctctccaaggaaatgccggcacgattgtcgtccaagcctaaatgcaaaaggaagggctcagggagggttcttccttttgccaatcgtcaaaaacaagtaaaatttaaagtatatagccgcaacataagaaaatcgataagggtggtccatatgaagaacaaagacatcgtacatcagctgaaaaagtttcctcttctcgcttccctgaataaaagagatctggaagatatgaaacagtttatctattggcgctcttaccataaaggccagatattatttatggaagacgacccccgggaacgaatgtaccttcttctcgacggctttatcaaactcgaaaaatcaaacgaagccggatccatgttttataccgactatgtacgtcctcataccctctttccatttggaggcttgtttcgggatgagcattatcactatgccgccgaagccttaacagatattgaactctactatatacccatgaacatcttcgaagatctcgtccgggacaacaaaaacctgctttacgatattctcaatcatttatcagacatccttgcccttcacgaggaaaggctgaagcgcatcacactctcccatgcccacgacagggttacacaagccatttattatttaaccgaaagcctcggtcaaaaagaaagcaactcaaccgtcatcaactgtccgatcaccgctgccgaaatcgccaaaatctcggggacatcccgcgaaaccgtcagcgccgtcctgaaaaagctccgctgcgaaggcgttatcagtcaaatgaacaagcagatcatgatcaatcggccggaatattttatgtaggcatatatgagaaatcatcccggcgacaagcgggatgattccccgccgtttttatttataccggaattcctctgtttcaaaccgtctgtttttgatgatatcccgataaaagcaagccgattttttcagcgccctgctgcggttgttctccaatcgaatctcgacaaggccgtagcggtttttaaaggcgttcatcggagagacgttgtccgtgaatgcccaaagcatatatcctttgcagtttgcgccgtcggcgatccctttcatcgcctctcgcaaatgggctgaaataaaatcgattctgtagtcgtcctgaatgaccccctcttcatttttaaaacgctcttcatgttcgacgcccatgccgttttcagcaatcagccattcgatatttccatactcatatttaagtctcatagccatatcgtacacaatgcgcgggcagatctcccagcctctgaacggattcatctttctgcctggcagctcaaagggctcatagtaataagcaggatgaaaaggcgtcgattcattccattgccttgaaggcgcttgaactctcttcggataatacaggttcacaccgacaaaatcgaccgtattccgcttgatgacggaaagctcttcttcatcatggtcaaaaaggatgtcgtgtttggccatgagctccatcaattcatcgggatagacgccttttatgctcggatctaaaaaaaccctgttaaaaaacaaatcataaacttgggccgctttctgatcatggggcgcgcttgacctcgcatacgcgacctcaggatttaagatgacgccgatttttgcgccttctctaaaactgggcttccttttccggaaaattgccacggcctttgctgtcgccagtgctttatggtagttccactgcatccattttttcgtgttctgctcgtacggatagcgaagtgcgtcaaggtagatccgtgtttgcggcacgatcggttcattaaaggtaaaccagtatttcaccctgtccccataccgttcaaacgctttttctgcataagccgcaaataagccaaccacgtgttttgatccccatccgccatactgttccagcaggacagtcgggatttcgtagtgctcaagacaaagcatcggttctactccgcatctcttcagctcatcgatgacgtcatcaatgtagcctgcatacacctcgtcaacttcggcggtttcataatccaaaagaaaccgcgaccagttaatggatgtccggtagtgggttagcccgatgtctttcatatattgaatatcttctttgtagcggttataaaaatcggttgccacagccggtccgtatccgtcatgccatacatcaggatcatttttgtaccacatatccaaataggaatcctgtgtcggccgcttcccgtcccacccctctgtctgccacgccgacgctgctgcgccgagaataaaatcgtcgggaatcttccacgtttgtctggccatctcattcacacctttctttgctttacatagacacatttttttcagaactaatcgtaaaggtccgattcaataaaataacaaacggaagataaataaggacggagacgatgatgcatacgatttgtgtgacgacggcaccgaggcttcctcctgttgacagccaggcattgataatcggcggtgtcgtccacggcaccatgacaacggcttttccggcaaagcccgccgctgtcgcgatgtaaccgatcgcacccgtcacaagcggcgtcacaataaatggaatcgccattaacggattcagcatgacgggaaccccaaagatgaccggttcattgatattgaagatgccgggaccaaacgaaatctttgtaatgctgcgcaaatcctcccgtttccccgcgataaacatcgcgatcaacagaccgattgtgacgccggatccgccgatgctcatgtacacatcccaaaacggcatcgtaatgatattcggaatcgattcgccggctgcgtatgcattcatattgacggtaatcgaagcgagcagcaaaggctccctgatcggcttcaccatctggtttccatgtatgccgatcacccagaaaaactgtgcgacaaacaccagcaagagaatgccgggaagaccttgaatcgcgccctcaagcggcttttgcacgacattgtacacggcttcatgaagatatacccccgtcagccgatgaaacgcaaatccgaagctggcgatgatcgtgacggtaataatcgaaggaaataaagtgccgaatgatacagagacatttgccggcacgctgtccggcattttaatcttgagccggtccatgcttgacagcttgctgaagatttcaacagacacaatcgaaataaacatccccaaaaacagcgacttcggatccgtaaattccttggccagcacgttaaccacttcctgcatcgaaccgttcacttccaacagcaccgccgatggaatgacagagatataggacatgagcgccatcaagccgggaaaaaacgattcatgcccattcagcttcccgagctcaatcccgatcaaaaacaccgcgccgatcgtaataaagttcagcgtcgcataattgattgacgccataatcggctcaagcgcagacaagaaccgaaaaggcctgaaaaccgcaagtcccgtctcggggctcatcaccatattctgcatcaaaaccgcaaacgccccggcaatgatgaccggcatcagtgtgacaaacgccgacttaatgaccatgatatatttgaaacttgtaattttaaaagcgacccgctcaaacatctcagtcaccttcgccatcctgctcatttactctccccctttttttggtggtttgcttttactttataatgaaaacgctttcttttcggtgcatattttttcctttgggagaggaaatttttcaggttggacggccagcaaagcagacaacccgccgtttcactgaaacagcgggtcatatattttactgtggcaactgcactttgatcggcttaaacggtgtagaataaaatgcgcttaaataaccaaattcgacatcaagcgaatatcggtcaaggctgaagtttttcgctccaaattcaccatctaacgtaaagtctgatcggaatcggagctttttaggatcaagcacttttgtaaaattaccttttacgctgtgtcccatcggcgcttcgtcaatgcttttataagcagaatcaaccagtgacatcgtttctaaaaagttttgcatgctgtcaatatcaatcttagattgatcgacatgtttcagatgatagtcgacagacaatttacttccgttttgtttcacctgatcaacggcaatctggaagtcatgacggtcagcgctcagcgcggcgggcgtttttgtgagaggcagcgtcttttcggaatcgcccatactgctgctcgcctcaatcttgaggtgttttgttcctttattcacttttccaaggatcagcctttcttcgtgacgaaccttgtttccgttctttgtactgtccgtcgtccactgcccgccactcaaataaggaatttcatttcctttatcatcggtcacttttataaccgatgtacgatcgttcggatgttcctctgaattggatacttcatagtcgatgacagtcgattcttttccgagaattaccgtttttacggcgagcttatggccatccgccgattgtgtattgtttttggttatgtggagcgttttatacggcagtttatcaaccggaatgtcgaacttccatttccctctgattccgttaatatttgtgatcgtaaccgggagtgtcagtttatcgggaatatgtttgtctggatagcctacttgaatgtagccggtatagccgtcctctgttttcttcaagtctccttgagaagcgatagcccatttgcgctcgccattaaataatgtgaaatgaatcattctcgctccatcatctaaatcttttcttgtatcgcttttcaccttaaacgtcataccgatgattccgccgtcaaaataaacgcttgtagctgtcacgtctatgttgttgctggacgctttctcgttcagttcagtgacaagctggcccgccaccaagttttggccgacatagtcatggaattgttgatacgcttttccaatcagcgggacgtcagccaacacgctttgcatcgctggggaaacgaagccgctaccgagaaggagcacggcggccgcgctcgaaacaaaaacagtccttttcacggcgcgcttcggccgaaacgttttttcccgcttggcccgcttgatgcctttatcaatcgattcgcggatttcttttgtagggacatcgatcttgtttacttcgtttttgaaccgttgtttgtccatgcgtcttctcccccagtcagtagttgttttaattcaagcttcgctcttttcagataggtcttaacggttccttcaggagcattcatcacctcggcgatatcatgaatcggcaggtcgtgataataaaataaaatgatggcggtttgatattcttttcgcaactgctgaacagcttcaagcatccctattctgtcgtccgcatgcatctcctgctcccggccttcgtcctgcagcggcctgtccattaaaaccactttctttttcttgtccaatatggcatatgcatgatgaatgaggattttcgtcagccatgtcaaaaagtattcgggattcctcaactgggcaatcgataaaaatgccttgtacgccgtttcctgtacgatatctaacgcgtcctccttatttcgcacatatatgtaagctgttctgtaaagctgttcgctgtgcttttgaaacagcatttcaaaagctttggcgttgcctgcgacagctttcttaactaatctgatttgcttcactgctgcgcctccttcaaacattagagaggagaaatgatgagaaaagtttcagaaagatggtttttttcacataaaaaacccgctttaggtaatatagcgggttcaaatgttagtttctgttggaaactttatgtttagataattcttcgtataaactttgcaattgttcttgacgaatcattccgttgattgaaactgtgccatcgggttctaaccgaacttctattttatttgaaattgattgaagctgaccttcaagataacgatatctctcagtcaaaaaatgatatcgttgattagaggaacctgtccatggccggcttaaatctatattttctttttcgaaaggaccatcaatgaacaaatcagtcaattcaagtaactctagctggccctttcgtggattcgactttatatcttccaagtatctgccgctaaaggtcaaaatagaaagtccagcaatttttattttatccgcaagttctgcaagggcttccgcttgatccattggctcaccaccaagaaatgttacaccttcaatattgttttctttttttgaatcaacaatctttttaaagaggtcgtctacactgatgtcttttccacccttgtcagaccatgtccacggtactccgcagccttcgcagcgtaccgaacatccctgcacccataaacacgcccgtttaccgggtccttctgcttcagtaagcggcaaaaaacgatggattcgtattttcattaaatatccaaaacccttccttcagcattctcatcttttctatcccttcggtcaactggtttagagaatgagagatacggctctaccttcaaaagcacatgcggcttcaatcctaactgttcgccgaaatgatcaatagatgaaaagccaccgatttcttcacgcatggcgaccgcttttttggcgaggataattcccaactgcggaatcgaagcgatgtcttccacactcgcttgattaatgtctattttccgttccgattgtttatcggtttggctcgttcgagccgcggcggtctctggatactcatttttcagagatttacgcagctgatctatttcagcgcgtttcaactgttgaatggactctaaccgaattaaaaactccggccgcacttttaaagcgtgaacaattgagacaccccagccgatgatcaaaagaaccatggccgcattgaataaaggtgttccattagaaagaatagtgaataaaaaaatagcaaaatagatccatccggcaattaaccattttttttgttttgcccgagcgaaaatatagaaaaaagaaacccaatttaaaaagccaaaaggagtaaatacaaataggacccatatggattgaaacagctcccatttcactcccttattggtatatccattagccattacggtgcccccttataatttgctgatgcctcaaaacatcaacctgttccgtctcaaagtattccgccgtatatgatgaatcaatcgtttcagcctcaagcagctgttccagaactcgaatataatctcggcatttcggtcctttaatcccttttgtttccacattaatttgaccatcctgctgaatttcaacaataattcgctgactcatgaaatgcctccttatccattcaccttgaacgtcaataccaccgaattctcatttgtcaccgtttcattttctaaaaccaatccttcatgttcggccttttctataagtttcaaatatgtttcctgctgcaatatccgtttgtactcctcttcaatttgatcaataaattcccgcgcctggtttttatcaactgaacgatcaaatgcagctttaaaggtgccttcttctgtcaaatggaaagttacagctgaatcttccatgattgcttcgacgtttgttgttccaagctcgatcgtcttacatccattttggtcaagcgcttttttgagaaggtcttcatccttcataacggtaggcattgtataaagacggcctgattcgttttctgccaaataggatgcaatcgcttgggtcgctgcaatcgcaactggtaataaaacaatttcaatactcatgctttgacacctcttcctaaaactctacagctctgccaccccggcttgtatgtaaatcggcatctttatcacgcggattttcgtcatctttctttagctgaatagattggtattccttcagatcttcctgacgggcagccgatacagcccgaagacttgcccattcccgaattgcaagaatttgctctgattgcgtaacagccaaaggaacagtctgcttaatcactttctcaagatcctcaaccgttaagcttcgattttcagaaaaggcttcaaataatgcagaaattacgacttgttcgatttcagcaccaataaatgattccgtcagttctgcaagcttgtccaagacaggtggttctattgaaaaattcccggcagctttcgggtttgttagcctcttttcaagatggatgcgaaagatttcttttctttcttttttcgttggcagatcaacaaaaaatatctcatcaaaacgtcctttccttaagaattcgggcggaagagcgtctatattatttgcagttgctatcacaaatacaggctttgatttttcctgcatccaggttaagaaattcccaagcactctcttcgaagtccccccgtctccagctgttccgctattccccaatcctttttcaatctcatcgacccacaaaatagacggagaaatggcctctgccgtagataaagcgtttctcatattttcttcactgcttccgacaatgccgctgaatatttttcccatgtccaattttaaaagaggaagcttccacatagagctgacagctttagcaattaagctttttccgcagccgggaacccccgttaatagaagacccttaggggatggcagcccatagtcctgagcggagtccatccatgacttgtttcttttattcaaccaacgtttgatattttccaatccacctacatcctggatatttggttcacttttaataaactctaatacgccggtttttttaatgatttgctgcttttcaaaaagaatttgatcaacgctatccgaatctagacgccctttgcttactagcgccagtgcaaacgcattttctgcttcttttaaagttaatcccagtgctgcttttactaggcgttcttcttcgtcctcagtcaagctaacgattgcccgattttgcccttgattcatttcgatcattttcttgagcgtttctttaatttctgcaaagctgggcaattgaaactctacaattgtgatgtccttttccaattcaggaggaagcgttaatgttggcgccacaagcacaacatttttggaaacaagactcttttccaatacagagacaagatctttcattttacgaatcaaacggtattcaggggggcgattatttgcacccaaataaacataaaaatccttcaatataaagactgctggctgatcatatttttcaatgaacgccaaagcctttaacgggtcttttgtttcggctgatggaggcattccattgctttcaaaccctttggttaaactccaaacaaataaggttcttggtgttctaatcaattctgtatccgaaacaatatgactcagttgatctatgacacgttcttcttcccatgtagaaatatacaggaacggaaagcgggccctgaaataattcgctacttcttttctaaagtgatgatatccttccatttttctccctttctattgacctattttttattattatactaaatttttccacaacaggaataaaagatttcaatcctcccattcgccttctctaaatgataagattaaaataaaaccaacaattggagatgaaggaaacatgaagaacaaattgattgaacgcctcatttcttatgcgaaagtggatacgcagtcaaatgaaaacagtcagacgacgccttccactcccgggcagctggcgcttgccaatatgcttgtcgaagagctgaaagagatcggcatgaaggacgtcacaatcgatgaaaacggctatgtgatggcgacgcttccttcgaatacagaaaaagaggtgccgacgatcggtttcttggctcatgtggatacagcaacagattttaccggaaagaacgtcaatccgcaggttatcgaacaatacgacggaaaggatattgtgctgaatgaatccctcaatgtcgtcttatcgcccaaggaattccccgagctagcagattatgcgggacatacgttgattacaaccgacggaacgactttgctcggcgccgacaataaagctgggatctctgaaatcatgacggcaatggaatatttaattgcgcaccccgaaatcaaacacgggaagatcagagtcgcttttacacctgatgaagagatcggcagagggccgcacaagtttgacgtcgaggcgttcaatgccaaattcgcgtatacggttgacggcggaccgcttggcgaactgcagtacgaaagcttcaatgccgcagccgcgaaaatcacttgtaaaggaacgaacgtccaccccggcacagcaaaaggaaaaatggtcaatgccgccaaaatcgcgatgcagttccacgccgcattgccggaaaacgaagctcctgaatttacagaaggttatgaaggcttttatcatctgctttcaatcaagggcgatgtttctgaaacgagcctctcttatatcattagagattttgacagagaccgatttaacgagagaaaagacaccgtccaaaaaatcgcaaacaaccttaaagcgaaatacggcgaaaacagcgtcacagtggacatgaatgatcaatattacaacatgagggaaaagatcgaaccggtcaaagagattgtcgacattgcctataaagcgatgaaaaaccttgatattgaaccggtcgttaaaccgatccgcggcggtacagacggctctcagctctcatatatggggcttccttgtccgaacattttcacaggcggggaaaactttcacggaaaatacgagtatatttccgccgacaatatggtaaaagccgcgaatgtcatcgtggaaattgtgaagctgtttgaagaaagagcttaaacgaaaaaagcggaaagcggctgcaagacaaagcagccgcttttttttccagatcaatctttatctgcgctttgctgaaattagaacatgttgcaaggcggtttctttttggagcgggataaagccaattaacatctcaccgatgcaaaaaattctgttcatttggcttcatcacctttccaaatatctttcaacgtccagtaagtgaattcttcaacccgtacgttgcctttctcagaaaacagctcaatccccgctcttccttccttcggatatatgcggcttgtcattgtcgcttcaccatgatttgcaaatacttcaatagacgatctgtcgagaaacagatgcaaagtgagcttctcatccgcttcaagccgtacgtttctcacaccgtccctcgctttgccggactttgaacagtcgagcgtcagcttttgatcaatcaagctgtacttgatggttgtttcttcctgttcaattccccggatctttaagccaaccgtttcggcactgcaaattgtcaaatcaaaaacggccaccacttcaagaagcttttcggctgtctttataaaatagctgccggaaatcgattgattgtcacactcatgatgttccgatccacgaagtaatttagtctcctcgacgggattcattaaaattttgtgaccatccttcaacgtcaattcacgcggcaaagttaatgccccgcaccatccgtctgctttcgtcggcatctctgactcccacatatccatccagccaatcgcaattctgcggcctttgtcatccaataaagtttgcacggcataaaagtcgtggccgtgatccaactctttaaaggagccatgtacaaactcattcgtttcttcatcatagtctccaatcaaatagcctgtttgatacagattttgatatgattcaccatcagcctctataccctgaggggaaatcagcaaaatgtgtttgccgtctagttcaaagaaatccggacattcccacataaagccgagatttccgtcgctttgggcgagaacgcctacgtactcccaatctacaaagttaggcgagcggtataagatgacccgcccgacgttctcttttgaggagtttccgaccaccatataccagttctcacgatgcttccatacttttggatcgcgaaagtgacgtgcgctgtcttccggcggctctgcaataacagggttttctttcagtttttcaaagacgataccgtctttgctgactgctatattctgagtttggtagaaatcgtctttctcttcatctatcatattatgcccagtatagattaaagcgaggtcgccgttatattcgactgcgcttcctgagaaacagccgctctcatcaaattcgtctcccggcgctaaagcaaccggcaagtgctcccagtgaataagatccttgctcttcaaatggccccaatgcatcggcccccaattctcatcatacggatgatgttgataaaagacatgatactcccctttatattgaataagtccgtttggatcatttatccagtttgcccggggcatcatgtgatagcccattcggtaacggcgattcacttttttcccggctttctttaatgcttcttctgcctgctgaattctgttcatctgtgacatcctctctatatatgattgctttgtagattttgagcaaattcaacatctttctttgagtctagcaaggtaaaaatcgaaataatggtaaaacaaaggaccattgctcccatgatgagataagtgtggcgaaatccgatgctgtcgtataaacctcccgcaagcggcgaaaaaatcgacgtgcctacctgggatgcgaattgaaagccgacaagataaagtacggatgaaagacgattatcaaaattagtcgccaaatatttaaacatcgcaatcagcataatcggcaattctaaagcatgaatgagtttcatcgatgaaattccgaccggtccgctgacaagtccggaaccgataatccggaaagccattaacagccccgctaaaatcaagctttttttaggaccgagcttattgacgatgaaaggcgcaagaaacatcatgcccgcttcaataaatacttggaatgaattaaggtatccaaatatttggttccccaaggccgcagtcggaaataaggaagcgtagtaaagcgggaactgctggtcatagacgccgtacacgcatgttacgccgatcacgtacagcatcaaaaaccagaaatcttttaagagaaaaagccctcctacgtcttttaatccgaccgagtctgctctttccttttcatcatctgtcatctcaatttttacggaaacaataatggccaccaatatgattgctgaggcggacgcaacccagaagttgatattcggatcgatattgaacagctgacctgcaaaaaatgtcgccgcagcccagccgagggacccccacatccttgttcttccatattcaaattgatatttgcggctgaccttttcaataaaggtttcaatcgcaccgattccggcgagaaaagcagttcccaaataaattcccccgacgatagccccaagaaagacgttgtattgcaaaagcggtccgtagacgaaaatataaaagggacccgtaaatacgagcagcaaactgatcataaataatatgtttttcttcagcccgagcttatcggagataaaaccgtacaaaggctgcatgcacaaagtaaagatagcgtttacagaaaagataatgcccgtcgcggacccgttcaaattgatttcttgccctaaccaaatcgcaaataaagaatagctggaagaccaagtaaaaaagaaaaagaaaaaataggcgcttagtttccaatacagactgtttgagcttttcattttcatttgctcctttaacccgatttggatgtatctatttgatgcctgtccctgaaccgcccaggccatctaaaatgtagcgttgggctacaatgtagatcagaatcagcggaatcgtggaaatcgtcaagacagccatcacctggttcgtataaaccggctcggtgctgttgatggctgtaatcgccacctggatcggaaatttcgacttatccgtcaaaaccatcagcggccaaatatagtcattccagctgccgataaaagccaatgtccccaccgtagcgacagccggtttggacatcggcagcatcacccgccagaaaatctgccatgtatttgctccgtccagcttggccgactcaatcatctcccccgggatcgccatgaaaaagtttcggaacaaataaatattgaaagcccccgcaagcgccggcaaaatcacggcaaggcgcgtatcaacaagtccgagcttatgaacaattgtaaactgcgagattaaaatcgtttccatcggcacgattaaaagcgccagcaatatggtaaacagcacttttttacctgtgaattgcagcttggcgaatgcaaagcccgccattccgttgataatgaccgctcccgctgccacacacaaaccgtaaaacagactgttaccaatatacattagtaaatcaaaccgtgacagcacttccctgtaggattgaaaccattccgacggatgaaaagacggaagaaacgctttaatgctgctgatattgttgtaaatatcggcttccggtttcatcgatgaagcgaccatccaaatcagcggaaatataaacagagccgccagcaaaacaaggcatatatattccagtatcgttaaaggtccgaatttccttctcatccgccttcatcctccttcaccaacttgcgctgcgcaagcgtcaccaatccaattatcgtgccaaacaagagcgcaattgaacttgcatagccgaccatccgatcggtaaatcccgtttgataaatataatagacaactgtcatcgttgaattgaccggtcccccctgggtcatgaccattggctgcacgaggagcttaaacgcactgatcagcgtcgtaataaagataaaaaccgacgtcggtttcaacaaaggcaatgtaatataaataaaccgctgccatttattcataccatccaattgcgccgcctcgtagacatctccgggaatgttttgcaggcccgctaaaaaaatcagcatctgaaatccggctccctgccagactgaaacgaaaacaattgtaaagatcgcctgattaggacttgtcaaaaacggctgtggcggcaaaccgacatgcgtcagtacgttatttatcattccttcattcggattcagcaagtacagccacaaaacggagatgacaacaagcgacatgacgacggggctaaagtatgcgactttgaaaaacgtattggccttgcgctttttattcaacagaagggccagcccgagagcggccccgatctgtaatggaatcacaaggacaacaaatttcaatgtgttgctcaaacttttcaagaaaatagggtctttgaacaatttgataaagttgtcaaaaccgacaaacttgcgcaggtcaggtgttaacaaataataatctgtaaatgcgtagtaaaccgccataatcgaaggaatcacgagaaacactgacaaaatcagcaaggccggacctaaaaatgtataggccagcacattgtcccgccaccctattttactggcagggatttttttcagcggaaaggccgtccttgcttctttcaacggaattttattcatggctccaccttctagtttgccttatcgatggctgattgcatttcttttgcacgcgtatccagaaccgattgaatatcctgatgctgatcaaagaagctgatgtcatcgatcgcttgctgaaatgcgcgcgtcacctgtggatatgccggtgtcaccggtcgtgcatgccccgtttctttcagctgctgcaagaagacattcatttcatctgagaattcttttgccagcactttctctgatgaatagcgcacaggcagcgcggcgatcgaacggctcaattccaagttggattccttgtttgtcatccaatcgaccaattttgccgcccattccttgttttcagacgtctgtgtcatggcaaactgccagcttcctgaaggggacacaagcttttttgtttttggcgacacaggatacggcatcacaccataatcgacattaggaaaatttgtttccatgtcggttaccgtccagacaccgctcattttcatcggatatttttccgtttcaaacgcctgcttaaccggagtccgggtcgtgtaaccctctttcagcattgtttgaataaatgtcatcgcttcaacggtcagtttgtcgttaaaaacaccctccgctttcttgccatcttttgaaagaacatcgccgccagccgaccaaacaaatggcaaaagcgcataggtcagcatttcgtcttttgactgcaactgcatatcgatggccggtttgtcatatttatttttcagctttttgcaaagctcaaggaattcgtcccacgtccatggattctcaaccgttggcagcgttttcaagtcaacgccggcgtccttcagcatttttttgttatagtaaataccgaccgatgattcgctgacaccgatcgcatacagtttcccctggtaggttccctgttgcttaatgctcggcaataaatcatcctggtctttgatatactcatccaatggcgcaataacgccggatttcgcataagccgccgtgttcggtccgtccaaagtgatcacatccggcagggtattcgttgtcagcgccgcgttcactttgtcttcatatccgccgccgtttccgcttctggggatgaaatcaattttggcctcgatgttttcagaggcatactttttattaaaagcgtccacccgcttttgatagacctttccttcttcactgtcatcagatacgtgcacccacatcgtaagcgttttcccatcttggctatttgcacttttgctattgctgcagccccacatcgcaaacatcagcaacaacgaaaaaattccgaagagccaccttttcatctttgtcacttccccccattttttatcaattaacaaatgaaagcactttcaagtgaattgtatgtcaaccggtttcatatgtcaaccggttgacatattttttccccaattattcatcccggtacatttctcagaatcatggcattttcttgcacatatcggcccgattctctaaaataagtgcgtgacgagaattgtaagccatttcagtaaaaatagcagggggaaaagggaatgaagcctagcattcacgacgttgcaaaaaaagcgggagtttcaccaacaaccgtatcgcgggtattaaataaccgcggctatattagtgaaaaaacaaaagaaaaagtctataaagcgatggaagaaatcaattactttccaaacgatttggcccgctctttatttcgtaaacgaactcatttaatagggctcatcatccctaactccagcaacccgtttttcggcgaactggcctttcatattgagagcatctgcgctgccatgggctacaaactgctgctttgcaacagcttaaaccgcaaagacaaagaagaaaaatacttggaaatgctgatgcgaaatcaagtggacggcgtcatcgccgtgacttacaacaggggaattttaaattatcatcggcaaaacctgccgattgtcgccatcgaccattacttgtcggaaacgattcccgtcatcggctctgataactatgacggaggaagaaaagcgacagaactgttaattgcaaaaggctgccggcacatcatccatatcaacggaccaattgagctgaaaacaccggcaaatcttagaagaaaagcatatgaagatgtgatgcgacaacacgggagacagccgattacatatgaagttccctttcatcaaaattaccgggaaatcatttcaaaactgtttgatgaacagcctgcagctgacggcatttttgccagtgatgacctcatggccgctacagtcatcaccgaagcaaaaaaacgcagaaaagacattcccgggcaattaaaggtgatcggctacgacggaacggaagcggttcagtccattctcccggaattgacaaccatccagcagccgatcgaactcatttccaagacggccattgagattttgtccaaagccattgaaggcgaattcgatgatttgccgctggaaacctatttgcccgtacagcttttagaaggagagacgacttaaaataacgggacaaaaaaaggagacattgacgtctcctttctccatacatatcctgatctatccaattataaaaaagataaaatttacattgctcacctaaaatttaacttatatttctagacaaactcacctccccatgataaatttaaagacaagttttcgaaaaattctaattttggcgtggaggtgcctttaattgaacgtaagccacttttttcctgaaacctttgtttctcttgtaaaagacatgttaaccaaaaccgatggttcaacaaccaaagcgattgaaacgctgatcggcggcaaagccgaaatcgaagtttttcagcaaaataatattgattatgacaagctttcacctgaggaagcaaggctgtttcaacgcgatgatgacatcttgtttagaacctcgtctttgaaaacaggcgatgattatttatcttataattatgtctatgtcaaaacaaacttactgccgcccgccatcaaacaagatttgcaggaagaaaggcttcccatcgggaaaatcattgcagaactggagtcaaggcgtgaaattttcagcacgggcgactgcctgggaaaacatttcacacaacttgtacctgtttcagcagaccggacatatgcttttaaaaaataccagatcatcagcggccgacagtgcatgttctatgtctgcgaactgtttgatttagaaaaaatctgcaaactgactgcgggctgaatcatgcccgtcagctgccgctttatgaaagagcttccaaaacctcctccttccttcttccctcataataaaaacccctgagaaacaggggctgttatttattgatacaccgttttcggaactgcaacgaccggatttccggcggcataaggggcgacatcgtattgttggaagacgatcgcaatgccgtcgttagtgtaatagaaggccgtgtttttaccgaggacgatgtctttcttcttcacatccggaaagaaaatgtcgctgtgtttttgaatatagttgtaaatgtatgtttttgtcttatccattttcgattttgtatttaggatgtcggataaatacacccgttttttagagacaaggtcatagttgaaagagcggactgccgtatttccgtgcgctccgccggaatagacgtaattgcttgtcaggatgctcagcttttggccggtccggtatttcacttcaaaggacgtttgataatccgtttggtatccgtgctgttggccgtctttcttgttttttacataatctttgtaggactgctcaatataatgtttaaaatctttgttgatcttgttttggagagatttggggcttacatttgaaacttgcgggtatttcaaagccttaatgtttttgtacgtatggctcgtgaccgtcggttttttttcgtttgccgcgtgtgcagaaggaagtgcggccgcactgtacagcgcaaaaaacaatacccctgtcatcaacattccgaacgctttaaacactgtttttttgttcataaaaaccctccttaatctgtcattttttataatacccattttgaaatcaggtacacattatagaccggtgaactcaataaaaagtttctgtttttggaaataaaaattgaaaaaaattctaatttattctgtttgttcagcatcttgttgactgtttgaacggctgtcctgacgaaaaattcacacattgattcgatacgccctccagtttaaccgcagaagaagaaaatgaaaaaaacgaagagtttttttaaacccattgacatttttataaaaagtattaatattaaaactattaaaaaatcgcataaaaaggttttccttatcaagagtggtggagggactggccctgtgaaacccggcaaccgctgtctatgacagaatggtgctaaatccttaagagcatgttcgtgctcttgaagataaggaggagattgaatatatcaagctcttccttatcgggaagagcttttttatgtctataaagaaagagggatgaagcatgacacaatcaaccgatgtactgaagcaaacgcctggaagaaaaatcggaccgtacagagctgatcaggtgggcagtcttttaaggtctgagcccgtaaaaaaagcgcgcctccaaaaagcgaacggcgaaattagcgctgaacaattgcgcgaagtcgaaaacgaagagatcaagcgcattgtcgaaaagcaaaaagaaatcggtcttaaagccgtgacagacggggaattccgcaggtcatggtggcatttcgattttcttgaaggacttgacggcgtagaaggatatacagcggacaagggcattcaatttcataatgttgaaacgaagccgcgcggcatcaaagtaacaagcaaagtcgactttacaaaccatccgatgctggaagattataaatttcttcatgatattgcgggcacacatacgccgaaaatgacgattccgagcccgaatatgctgtttttcagaggaaagcttggagaaagcccgtatgaggatcttgatgaatttcatcacgatgtagctcaggcttacaaaaaagcgatccgcgcattttacgatgccggctgccgctatttgcagctggatgacacggcctggtccgtatttttctcagacaaaggacatgagcagatcaaagctttcggccgccagcctgatgaactgcgccagtctttcgccaacacgattaatgaagcagttgaagggcgcccggacgatttgacggtcaccatgcacatctgccgcggcaacttccagtcgacatgggtggcggaaggcggctacgatgcggctgctgaaacgattttcgacggactcaatttagacggacttttccttgaatttgatgacgagcgctccggcggcttcgaaccgcttcgctacgtccaacggaaagacttgcaaatcgtcctcggtttaattacatctaaattcggcgagcttgaaaacccggatgatattaagcggcgcattgaagaggcgtcccgatatgccgatctgaaccagctgtgcttgagcccgcagtgcggctttgcttcaacggaagagggcaacctgcttaccgaagaacagcagtgggaaaaactgcgccatgtcgtcgagatcgctgaagacgtatggaaataacacctcatatttgagacatgcctcctgacggcatgtctctttttttgcccctctatacaatttaaaattccttcttgatttgttcatagtttgatcatatttggcttctataatgctctttagtgaggtgatcgaacaatgattaagaaaaggaaaatcgatatattcctggtcttcattcttgtattatctgcagcattaaacttgtacggcatctggaatagtgacacagacaacgcctactatacggcggccgttgaaagtatgacccaaagctttcataacttcttttacgcatcatttgatccggcaggctttgtaacagttgataaaccgcctgtcgcactctggattcagacactttttgcacttgtattcggcgtgcacggctggagcgtcgttctccctgaagccattgcggaagtgatttccgtagcactcttgtactttattgtaaaacctacttttggcaaaacggcggccagaatttcagctcttattatggcgtgtacgccgattgccgttgcggtcagccatacaaacaacgtcgacagcattctcgtcctttgcttgatgattgcaacgtggctgttgtttaaagcagtccggaaaggaaaaatcggctggctgctcggcgcattctgtatgatcggtgtcggttttaacgtcaaaatgctgcaagcttacatggtattaccggcattcctgctgttttacatgattggagccaaaacgacgattcgcaaaaaagttgtgtctcttatcacagccgtgatcgttctggcaggtgtttccgtttcctgggcggttgtcgtcgacagccagcccgagatttcgcgcccttatatcggaagcagccagaccaactctgtccttgagctggcgtttggctataacggcatccagcgtctcacaggtcaaaacggtgcaggcgggggcggaacctcctcatctgatcatgatcaaaagaatcagcagcaaagcggcgatattgaaaacaactcagactcggcaaatggacaaatggctccgccgagcggaggcgaaatgccttcgggcggaccggatggccggcagggtgatgtccaaagcggcggcggaggtcccggtggcggcacaggcggcatgtttggcactggaaccccgggtcctctcagactattccaatctgagctttcaggacaggctagctggctgatcccgtttgtcctcttcggcatcatcggtttgctgatcgcgggtcttcgcagacaaagaaaattcaatgaaacaacgactgaaacaattttctggatgatgtggcttctgccggtcgctgcattcttcagcatcgcaggattcttccatcattactatctgattatgctggcagctccaatcgccgctttgtcaggtgcaggctggacggcgctcgttcgcctctatcaggaagaaagcggctggaaaaaacggctgctgccaatcggcattttgctgacaaccgcatttgaattgtatattttgagtccttatctcagcgaaatcggcttcatctggagcatattgatcggcgctttcggcattgtcacaagctgtcttctcatctttctcaagaaaggaaagtcattcagctactatgtatcacttgcagcgctgcttggcatgctgatcgggcctttctattggacaacggcgacgcttgctgacggtgtaaacggcatgattccacaggccggacctaaatccgcacaatcatttgccggcggtggcggaggaggtaagatgcagaataacgacggcagcggacctcccggatttggcagccaagacggccaaacagacagtaatcaaaacaacaataatggccctggcttcggtccaggttcaaacagccaaaacagcaacgattcttcagctgataccggttccggccaaaacagccaaaatcagaatgacgaaggcgcaagcggccgtcaacaaggcagaccaagcggcggcggcagccctggaagcggcgagtcggtcgatgaagaactgttgagctaccttgaaaagaacaacaccggtgaaaaatatttatttgcagtctcaagtgcaacttctgctcaatcttacatcatcaaaacgggcaaagctgtgatggcgatgggcggattctcaggaagcgacccgattttgacggttgaaaaacttgagaagctcgtcaaaaacggcgaagtcaagtacttcatgatcggcgacggccgaggccgggacaattcagaaatcaccaactggattaaagaaaacggcacagaaatttcaaaaagcgaatacagcagctcttcttctgatgattcacagtcaggcggacctggcggaaatcaaacgctttataaagtggagctggattgatgaaaggaaaggtgatgaatatgcagaaacaagtcacattttcaatcgtagtccctgtctacaacgaagcggaagtgcttcaaagcacctatgaccgattaaaaaccgtcatggactcgacaggcgatccctatgaactgatttttgtaaacgatggttcaagcgatgacagcattcacacgctgaagtcgcttgctcagtcagaccaggcagtaaaatgcatcaatttctcaagaaacttcggtcatcagatcgcgattacggccggcacagactatgctgccggcgaggcgatcgttgtgatcgacgccgatttgcaggatcctcctgaattgattttggaaatggcggaaaaatggcgccaaggctttgacgttgtatacgccgtccgcacaaagcgagaaggagaaacatttttcaaaaagcaaacggccgccatgttctaccggattttaagaaaacttacagacgttgatatcccggtggatacaggagacttccggctcatggaccggaaggtggtcaatgaaatgaacaagctgaaagaaaaaaacccgttcgtccgcggtcttgtcagctggctcgggttcaagcagacagccgtctattacgagcgccacgaacggcttgcaggggaaacgaagtacccgctgaaaaaaatgctgaagctctcgctcgacggcatcacttcattttcctttcagccgctgaaactggcaagctactcaggaatcgtgctgtcagcgatcggctttatatacgccttcatcgtcgtctgcatgaagctgtttacgacaagcaccattacaggatggtcgtcgatgatcattctgcaatgcttgttcagcggatttatcctgatcatcctcggggcaatcggcgaatacatcggccgcatttatgacgaagtgaaagacaggccgctttatatcattgacggaaaatacgggtttgaagaacagcggcgggcgcgagctccccagcgccatattatgtagaaagatccaaaaggagggattccgatgagcgtactagttgtcgggggagccggttatatcggttcccacgccgtttacacgttaattgagaaaaaagaaagagtcgttgttgtggattccctggcaacaggacacgcagaagccgttcactccgaagctgcgttttataaaggggacattcgcgaccggcattttctcaagcaagtatttgaaaacgaggacattgaagccgtcatgcatttcgcagcatctccgatttcctcgaaatccaaaaacgtgtttacttcctttaacgaaaacatcacaggaatggaaacactgcttgacgtgatgaaagaatacgatgtcggccggatcgttttcgcgtcaagcgcggccgtctacggcagtccagaagacctccctgtcacggaagaaaccgaacctgagcccgttcacgcgcacggcaaagtcaaatggatgatggagaaaatgctgatggaagcggaaaaagcgtacgggctgaaatatgtgatcctccgctccttcaatgcgtgcggcgctcacccatccgccatcatcggcgaagaccgggggagcgaaacacatctcatttcaaatgttctgcgaaccgctctcggacaccttccttttgttcacatagatcaatctgaagacggaactggcgtccgcgattatgttcatgttcaagatttggcagaagcacacgtgctcgccatcaatcacttgcggaaaggcaaggatagccgaatctacaatctcagctatggcgaaagctactccgctgaacaaatcatccttgccgcccaatatgtcacaggcattcccctcatcgccgcaaagctgacagaaacggacatcgattcacaagcaacatttgccgcttcttcctccagagccagaaaagaattaggctggaccccacagcacaacagcctgatcgcgatcatccgcgacgcctggaactggcactctgcgaatccgaatggatatgcgtcggagaaggtgaagcaagggtgaaaatgaactgcacccctatcgttaggcagcgtctaactatggaggtgcgtttttttctccatcggctttgcggtagttggtgatcatcggcaggccattgaaatgtttttatttgagttccaaaaattacagaaggcttgtcccaattttgtggcctacctttgtcaaataagaaaaggactgcataaaaactcttcagtccctctatgattcaattcctaaatcaactaaataagccgttggctgttgtttgtttttttgtaaatcaataagtacattaacagaacctgctgtaccaattgtcttcccatgataagaaatatacaaaactacataatctttattaaaataatgaatattagctatcctcgcatcacccgcgtttaaatccatctcttttgcaatttgtttgaaatcaatcttaaattgagcttcatatttttcatttccttttagataattatccattgtttgtatctgttggataccatcaggcattacatttgtttctttttcttttgctccgttaatataaacatacttaccgtctttgctcagaatatcagtgtttttgattttcctaactttgtttttcttttcatcaaaaatgtatttatcaaataacttacgatatgctccatccttcgctacatttggaaatacggataagtattccttcagtttcccagactcaattgttgaatttaattcctcttctttaacaatccggtattttgaaagatcactttttaaaaaaagataatatatttgtctgtctccaaggtcaccatttttaaatttttcatatacgtccacttgtataagcatgctgtctttgctaacagctgctaacgccagatgtacttttttatccttggctgatggaaactctatttttttttctccgctttttgttttcacttttagaacattctttttatctaatgtcatttccggcagattatattcaagtttattgtggataagtttttctttagttaaaaattcagttgttttcaaatcatataattttgtcgcaggatatttattagccgaaagaaagggactgtaaaaatcgtctacttcttgatctgtatattgatagtaccgtagcccctttttatcactgcgcataatcgtatatgtactattttgataactaagagttgcgtctgtcgctaaatcaagttcatgtctcataaattctctaaatgctggactgtcttctttgggcaagccttttttatagatggcttcctgaacatcatctttgccgcagccggtggtggcgagcagtagaaacactattaaaaaaaatatacttataaaccctttctttttcatcgaccttctcctattctgcttcttttttgttgacctctcgaatcaagtcaacaaattcagagtcttcaatttcataaatatgtccaggattggttacaccggaacctcttacttcaatttctggctttttatcaatgagatcgcctaatatgtcaccgtgttgactttcgaccgaaacgatatcatcactgtttattttatgttttccgcttgcggtatagtaaggggaaaaacttacagtatcctctgttctgtatcccgccgcagcggtaatgtccatcttctgcagcttttgatacacctcaggattggcagatttcaaatgattaatatcttcagtcatcgcctcacagtccatatcagtgtaggcattactgtaatcttttccattatcattgtttttgttttcttcattaaaatctaaataatcacttgtattcatagtatctcttccagcagcattatctgcaagccagcgcgctctatttgccccggcagctaagagatttttatcatatggagttccgattgttgtgatgcttcgcacatggtcagggtaatccatcgcaaattgcagcgatcttcttcctccatagctgtgcccgaacatatcgatctttgtctcctcattcatcagccccatctcatttaacttttctgctaaatcgtcacttgttgcttgccgatgctcattgggttcatttgtgtcataaacaatatggagacggccgttagtgtcgaagtattcaagaccttttatttcttcataagtttcctttatatacatttttccatatttgtcaatataatagtattcataaacatattcgtttttttcatttgttgtaatacgaacgataaggtcgccctttttcgcagcatcctttacacttttatagaaaccattcccactatcctcaatcccatgcacataaacagaaacattcttataatccgaaaaatcgccttttacatggttaactgaattatacaagattgagaggtctgtcaaagcttcgcgcatcggggcgcggtgggtgcgggcgacattgctgaaatcttgttccacctgatcaatgccattttttagattctcgtattggctaattaaaagaacagcgtcactcgaaatattgttgcgttttcttaagtcttccggtgtggggtcttccatagactcaaatttgcgcctggcattctcctggcactcttttaaatcctttatccaatcgttgatttccgatttgatatccgccacattaaaatccattacgttttttgatacaaaattcggaagttctttattttctatcgaaacccatattttattaaaagtatcaagcagacggctggattgggctaaccgcagcagctggttcgcttttctttcatggtttttgagaatgttcgtgatttctttttctctattatgataagccataactctgtttcccttccatcatttcactctttgcagttgctgtgagattatgttatcgacgcgctttaattccttaacgatgtttttagcatttgccgaaagttctttgactctttttttaagctccgtcatgattgagttgatgtgcgactttgcatcagaccagacgtcatcgaatttttcccacggaaattctgtttcatacatcatttctctgagcattgtgtcaaaatggtgcaaaacttcatcaagtgtagatagatttgattcaaactttccggttgcctggtgtaacgattcaccgtttactttaatttcactttgaactctttcagccgaaaacgtatggtttctttctgatctcgactgcggctgaacattggccggcttgtcggattcgtccgtcagttcgaccgcttttgcaaaacagcgtacactgtctgcaaaatataataaacagctgcttgctttactgaaaaagttgatgttgtcgctcatttttttctgcagcgctgctgcggcttttccgctgtgccggtctaattcttcacgaaaaaacaccatgttctcaaatacatggataaaggcgttttccagctgactaatggttcccgctgccttgtgtgaaagttctttgttgaagcgaaaatgtcccatcgtcattgctccttattttctttttttcctgcttcagcttctgttagcagttcatcaagctgcaattctttttgatcaacatacccgtaatggtataccacttctatgtcctgtttattaaatagaacaagctgctcttttggatcggtaaatccatttggatagtcgacagctgcataatctctgatcacgtgatttgtttcagaaaacatttgccggccgatgacgagcagacgccttgaatcattatataagccgacaacactgccgacaggaagatagttcttttttaacagcataattcattatccctctttttctctgaaattggacatacatacaagttgtaaaaacataggaaaatcatagcaaaaaggtatcatttcattcaacgaactaaagcaccgcgaaattttgcctatttaaattcagagacttttgatttaatgttcgctcattacgcaaggtttgtcggtgtcattagtatgttacagtgaggccttagcactgaaacgattcatcatacttacgggaacttccagataaagtttctcaaaaaaaccgccataataggcggcatcatgaagatataaagcgcgatcgcttacgattctcctctaataaaaagaattttatcactttcaatttttcgtctgttgttctgtgcatcgtcacttcaatcatttttcccgcttgaaaatccggctttcaaagactaagcaacaagcgccctgaccctctcctagacatgacttcatttgaaatgtgaaaatatatttttagcttgaattttacacaatctcgagataaaatacagtcaaaataatagaagcccacttcttgtatataatcagtaatagggtctgattgtttctacctggcaaccgtaaatcgccagactacaaggaagtttgaatagatttgatcatgtaaaaagtgtattgcgcaaacaatatatctatttttcatttgctcttatttttcatgctttctttatcggaacccatgaaaaataagagcttttttattttcaaaaaacattcgggagttggcatcatgtattttctcattaatattttaggcattttcattgtcatgtctgtaatttatttttgttccccgcgaaagaaaagcgtaaaatggaggccgattctctcccttttcatcgttgagcttttggtgacgtggtttatgcttgggacaaaaatcggcggatgggccatcaacctgatcgcctctttcttttcgtggctgatcgcttgtgcaagcgacggcatcgcttttgcctttccgtccgtgatgggcaatgaaaccgttgactttttcttcagcgccttgctgccgattatttttgttgtgacattttttgatatactggcttatttcggaattttaacatggatgattgataagatcggctgggtaatttcgaaagtctcacgccttcctaaattagaaagtttcttttcgattcaaatgatgtttctgggcaatactgaagcgctcgccgtcattcgcgggcaattggctgtattaaaggataaccgcctgctgacgttcggcattatgagcatgagcagcatcagcggatcgattctcggttcttatttaacgatggttcctgcgacatacgtatttaccgccatcccgctaaactgcttaaatgcgttgatcttggccagcattttaaacccggtggaagtcactaaggatgaagacattatttacgtaccgccaaaagaagagaaaaaggactttttctcaacgatttcaaacagcatgatggtcggaatgaatatggtcatcgtcattctcgccatggtcatcggatatgtcgctttaacctcatgtttgaacggtattttgggcttgatcgtagacggtttgacgattcaaaagatcttttcttatatcttcagtccgttcgcattcctgcttggactggcgccgggcgacgcgatgtatgttgcacagctgatgggcatgaaactcgccacaaacgaattcgtcgcgatgatggatttaaaaacgcagctagacgcgatttcaccccatacagccgccgtggccacaacatttttgacgtcgtttgccaacttcagtacgatcgggatgatctatggaacgtacaattccttatttaacggagaaaaatcggcgattatcggaagaaatgtgtggaagctcctcgtcagcggaatagcagtgtcgctgttgagcgcggggattgtcgggctgtttgtttggtagaaaaatagattaaaagggcaggcatctagcctgcctgctttattattaaacttgcctatcccaatggcggtgcccgctgatcgcttcgaccagctttttgccgaagtcgtctttgttcttatcaccacgagaggtgataatgcccggctgtgaagccgcgtgggccccggcggcggacagcaggagatcgaccccttcgcctgcggctccgaccgctttataatgtccgaatgcttcattgacaaaatccgatgcggctttatgcaatttcaggcgttctatgctttcttggccgcccggaatataaacggcatcgtacagcacagaatcgaccgtctgcaaagtgtttccgacttcaatttctgtgccgccggccccttcgattactccgagtgccgagctgacgatgtccggaatgatgccggcttttttgaattctttcaacacacggctcaagtcttcatcatcaaaaccttgttctgctaaaatggcgactgtccttgtctgcggcagtttcaccgtattctcctggctgagcgcaggggatttgaacgtcacgttggagccttcgtctttttcagggggctctacgcctacacccgcagcgatttgcttggcaagctccccgtcaacccggttaaacatatgaacgacttggcggcggacgtccttgcttttgacctttccgacttcaaagcggaacgccgaaatgatatgttctttttcaacgggggacatgctgttccaaaacagcttcgcttgcgaatagtggtcgttaaagctttcgctgcgctggcggatttttttgccctcgactttttcctcgtagtgcacatatccgccttcttcttctgaagcaggcgccggatcgttgttttgaagcgaatttttatgataagcgacaggccctttgttaatcgtcatcctgtgatagccgtcatactggttgttatggaacggacagaccgggcggttgattggaatttcgtgaaagttcggacctcccaatcggatcagctgtgtgtccgtataagaaaagagccggccttgcaatagcggatcgtttgtgaaatcgatccccggcacaacatggcccggatggaaagcggcctgttcggtttccgcaaaaacgttatcctggtttcgattcagcgtcattttgccgatgattttgacagggacgatttcttccggccaaagctttgtcgggtcaaggatatcgaagtcaaacttgaactcgtcttcttcgtcaatcatttgcacgccgagctcatactccacttcatcgcctctttcgatcgcttcccacagatcgcggcggtgatagtcgggatcttttccggcgattgtctgcgcttcgtcccagacgagcgaatggacgccgaggacgggcttccagtgaaatttaacaaagtgcgccttgccttcttcgtttacaaacctgaacgtatgaacgccgaagccttccatcatcctgtagcttcgcggaatcgccctgtcagacattgctcacatgatcatgtgggccgtttcttcattgttggcgacaaagtcccaaaacgtatcgtgcgccgtagaagcctgcggcatttcgttgttcggttccggtttaaaggcgtgcaccaggtcagggaacttgatggcatcctgaatgaagaaaacggggatgttgttgccgacaagatcatagttcccttcttctgtataaaactttgtcgcaaatcctctgacatcgcgtacagtgtcacccgagcccctggaaccggcgacagtcgagaacctgacaaacaccggtgttttcactgacggatcttgaagaaactttgctttcgtatactccgtcatcggctcgtaaacctgaaaatagccatgcgcgccaaaccccctcgcatgaacgactcgctccggaatccgttcatggtcaaaatgggtcattttttcacggaaatgaaagtcctccatcagcgtcggaccgcgcacgcctgcttttaaggagtgctcgtcttcagatacgcgcaaaccttggttcgtcgtcatttttttgcccctgttgtcagaccggtactgttcgagttgttgatccttgctgtgcccattgactttgcggcggccatcattgttattcacttgtcatccctcctcatttttattccctatgtagctgatctggaatgctattttatgatttaccctttctgtcggcgggttaaactctttttatagattcaaagttttgtgtgacaactacacaaaaaaacgaattaaaccgattttaagggcacacatatttcgcaatacggactgttcaccatatcaccaacgtatttttccatgattggcctattgtccaattggtatttgttttgcagagatgagaaaatatctgaatatgctttttgaatagcttctgctgtatgttcaacctcgtaaataaggtattgtccgccggaaatttcgccttcaaaaacggtatcatcgacttgataatcatgcggtatcacaatacaagcatcaaatcgacaatgatcaggaggcgttgttttcgggttatcttgtggaatcgcaaacagaatggcggattcaagaagatcttttttcttagcccatttttttaatctttccattacctcaatgttggcggggccgtatggaccaactcggcgcatatatgcaatgcggtagtttggaagtgtttcgattttgaatttcataggttctttcttcctttccatcattgttgttcgttccgtttcgaatgtaacacgctttaaagatatttacattcatatttttaaaattttctgcaaattttaaaatgagcattttcaaaccaaaaaagaggatattcagagatcatctgaacatcctctttctttgtttaatcgagtgtttcgccgtttgtagcaatcaggtttttataccagtaaaagctttttttgcgaatgcggcgcaagtctttcaaatcaaattcatcgcggttcacataaataaatccgtagcgttttgaacagccttgatgggtcgaaattaagtcgatggcagaccatggggagtagccgaaaacatcgactccatccgtgattgccagctgaatttgcttgatatgctcttttaaataatcgatgcggtaatcgtcatttacgacatctccgtcttcaagctgatcaaacgcgccgaggccgttctcagtgacgatcagcggcagctggtagcggtcgtaaatttcgcgcagcgtcgaacggaaaccgacagggtcgatctcccagccaaatgcgtttttctttaggtgcggattgctgcttcccctatatacgccttcttctcccgtctgcaaatgctggtctccgcctcgagcagccgtgtcgctgccatcacccctgcttgcttcagccgtttgcgatgtatagtagttaaacgcgataaaatccggcttggccgaccgcagaatgtccatatccccttcagcgatgaccggtgtgcagcctttttctttcatatatgcccacgctgttgtattgtaccgtccgaatacggccatatccaagtaaagccagtttcggatcgcattatagttaaaagccgccagcacgtcctccggtttcgaagaagcgggatagatgagcgcaatattcggcgcaggaccgatttttgcttccggcagcatctcatggcaaagcttgatcgctttcgcctgtgcgacgagcatgtgatggttttgctgataaagctcttttttcggattttccaagttcggatcgagtgtaccgagtgcagatccgtggaggatcatcatattttgctcattgatggtcagccagtatttgacgcggtcaccgtagctttcaaaaaggaccttcgcatacttttcaaaagcatcaatcgtggccctgtccgaccagccgccttttttctgcaaagcattcggcagatcaaagtggtacatcgtaacaattggttcgattccatactttagaagttcatcgatcaaacggctgtaaaattcgattcccttcggattaatatcaccgtccccgtccggaatgatgcgcgtccaggcaatcgaaaaacggtacgctttgaagcccatttccgcaaataaagcgatatcttctttatagcgctggtaatggtcgcttgcgactttaaaatcggttgtcccttccgggtagctttcgcgcgcatcgatgacagaaggcccttttccatcttcgtcccaagcgccttccacttgataagcggaagtagacgcgccccacaaaaaatctttcggaaattgagctaatgttttatatttcatgattattttcctcccttggtgatgaaattaaagtgatgatccgttcttcagttttcacctttttttgatccgttggaatgacatccgtgtattgaccggaatttgtaacgatgatcggcgttttcacgtcaaacccttcttctttcaaagcgtccagatcgaattctgcgagtatatcaccccgtttcacattttgcccctgcacggctttaggattgaagtgctttccttcgagcctgactgtgtccattccaatatgaatcaaaatctcggctccgctttcggtcgttatgccgtatgcgtgacccgtcggaaatgccgttgtcacgatgccgtccgcaggggcggtgacaacgccttttgacggaaccaccgcgattccctctccaagcgcccccgatgcgaacactttatctgatacttctgttaacggcaggacttctccttgcaaagggctgtaaatcggttcaccggcgcttttttcaacaggctcctcttttgtcacctccacagggtcgtcaaagccgacaatgtaagtgagcaaaatcgataaaacaaatgaaactgaaatgccgatgatgaagccgagaaagcccggtccgtaaaaaatcggaatcgtcaacaagcccggagcgccggaagcgagggcgacgctgccggagtatccgataatggctccgcctgccgccgcgctgatgacaccgcatacaaacggctttttcagcctgagcgtcaccccgtagacggccggctctgtaatcccgaatatcccggtaacggcagctgatcctgccaatgctttcagcttcttgtttttcgtcttcagcatgacgccaaatgcggctcctgtttgggcaaacacggcggctgccgtcgccggcttaatgtagtccttgccgtggacggcaatgttgttcaaaatgacagggacgatcccccagtgaatcccgaagatgacaaggatttgccataaggccgcaataatcgctcctgccagaatcgggctgaaatcaaaaacggacagaatcgccgccgcgatcccgtttcctgtgtaaacgccgagcggtccgaatacgatcaaagttaacggcaccatcaccgtcaggcataataaaggggtgataaagttcttcacgctttcatgaataaagcgcatacataatctttcaagatagctcatcacaaataccgcaaggataatcgggataacggtcgacgtataattcatcaagacgaccggaatgccgaaaaactccgtatgggcgccgctgtttttcagttcgagtatcgtcggatagatcagcgctccggcaatcgtcagcgctatgaacgggttcgctccgaattttttggcggccgtaacggcgagcagcaaaggcaggaaataaaacaggctgtcggctgccgcgtatagaatcgtatatgtcgtctcttccggcgagagccagccggcgtttgtgcaaatcaaaagcaggccttttaaaatccccgctcccgccatgacgccgagcagcggagtgaaaatgctggatacgacatctactaatctaccggcgaggcttcctttctctttttgactgtgatcggccgcagaactttccaacagttgagagatccggccgatttctttatatacttcaggaacgttattgccgataacgacttgaaattgcccgccgctctccaccacggttaccacgccatccgtattttcaagcgcttctctgtctgctttggaacggtctttcagtttgaagcggagccttgtcgcgcaatggactagcgatacaacgttcttctccccgccgacgcgcgccagaatttcttttgccattgattgaacattcatcgttgatcatctcctgtctctcgtaaagccctatcaagctgttaaaaaataaaaaacctaaactaaagcctgtacaaagaaggcttagtttaggttttgcctgccgaacagtaacaatcccacttaagacaatatgaaaataaaaaaacctaaatcactatgaaaaacaagggcataagagtcccccttcacagtcatttaggttttgcctgcatcatcagtaacaatcctaacaacctgtataagttgatgtaagtaaaaagtagcatacatttatccaattgtcaacgctttcatttgatatcatcctctatttttgatgaacgactcgctcgatatgaatcgtcaaatacagaagctcttcgtttgtcagctgatgaccgtattctttttcgatatactgcctgattttatttgtacaaacataagcgtcccggtacttatttttgacggtttcaaataaaaagtcgtcccggctttccatataggttccgctgaacagccgctgggcgaaaaatttcaaatgggtaatgaagcggtaatagtgaagcgattcttcgtcaaattcgatatgaaagtgatacttgacgatgcttaaaatctcctgcatgactttcgtaatattgacgatgttcggcatttcttcattcagctcggcgtttacgatatggagcgcgataaaggcggcttcatcctccggaagagctgtccccgtcttcttttcaatgatggccagcgcctctttgccgatggcgaactcatctttatacagccgtttcgtctcccaaagcagggcatttttaatatccagtccctttttatgccgttcgacggcgaaatgaatatggtcggtcagcgagacataaatgctgtcattcagctttttgccgagctttaatttcgcataggagataatttcttcagacatttccataaattcaattggaatttcgtccaacagcgtcttaaacctttctgatacatctttattatcaagcctgaaaatcttctcgattctcgattcatccaccgcttcgccaggctttttttgaaaagcgattcccctgcccatgaccactaattcctgaccctgttcatttaaaacactgatcacattgttgttgatcactttggcaattttcacatcgcgccactcccatcttttaaggggatttttttatacttcttttttcaaatggtacacattgattgtacaacctttttggcctaggtcaatatatttcagtcaacgtccgaaatgtttgcattttacagaatgcccgcctgtacccgggtttataaaaaaagagccgcaaggcggccctgtaaaaaaccttcttaaaaagtgagcaaaatccccgctgcgactgatgccagacccgcaaaatatacgaagtcttttccggaaagccccgctgtttgatagtaggtgcggtcttttgtaccggtaaaccctctcgcttccatggcaacggcgattctttccgatttgcggatgccttgcgaaaacaacggcagcgcatagcgaataaacgccttccagctgtttttttgcttatagcccctgattttgtgcgccgccttcatttgcgaaagctccgactgaaaaagcgggacaaaacggaagccggccagcaagccataagcccatttaggcgacaatctgcattgatgaatcaggctcataataaactgcgtcaaatcggttgttgacgtaaacaagagaccgtatgtgacaaagccgagcatccgcagcgcgattgtcagcccattgccgacgctttcctcggtaacgcggaaccaggcccattcccaaatcgtttcctcgcctttcccaaaagcggccatcatccaaaatacgagaataaaaaaaataagataaggcagcagccgtttacttaaataagacaaagtccatcccccgaaaaaaatcccgatgacaaccgcaaacagccaaatgaaaaaagtcggtttcggatttgaaacaaacatgagaatgcacatgaccaggaggtgggaaaagagcttggcgctcgggttcaatgccgaaagaagtgaaccattgcttttcatacgggaaccctctcctttctttcgtgcatgaaccggtagtgaagcggcggtatcaatgaaaagcggcggaccaggtcttggtcagagaacaattgatacggcgttccttgatatgccgctttcccttgatgaaatacgatgacccggtcggagtgctcgtctacgatgtccatgtcatgcgtcaccatcacaatcgtcgttccccgttcctgccgctcctttaagcgcttgatcaattcttttgccgtcttttcgtcctgaccgaatgtcggctcgtcaagcagcagcaaatcctggtcaaacaaaagcatcgtcgcaacgcttaaacgccgtttctgcccaaggcttaatgtaaagggatgcgctttttgatgaccatcaagtccgaattcctgcagcaattcagccgttttcctttcgacctgctcctccggccagctccgctgtctcgctccgaacgcgatctcgtcaaacaccgtgtcccgaataaattgaagctcggggttttgaaagacaaagccggccttctcgtaaagcgtacgatcggaccatttcttcagctcccggccctccagataaatgcgcccttttttgaccgcttcaagcctgatcagactttttaaaaacgtactctttccgctgccgttcccgccgatgacggaaatccattcccctcttggaatctccaggttgatgccgtcggcaacgatctttttccgatagccgatcgccgcgtcctctgtgcggatcaatatgtccctgtctgctgacggcctgtttttcgcttcctcctctttcattttcaatgtagaagagagcttgacggcgagcggatgatcatcttgtgtggtaacatcttcccatactgcggggtacagtttgggctgccagatgcctgccgctttcatttccggctgaaaatgtttgacgatttcttccggctttccatcagcgatgatctgtcccttttcattgaaaaggatgactcggtccatccactcgatacagccgtccagcacgtgttcgacgaacaccatcgtctgtccgctttttcgggaaacgtcgcggagcaaggcaaagatgtcttgccggctggccgggtccagctgcgccgtcggctcatcaaaaaacagcacttcaggctccaaagcgagcaggcacgctaatgccagcctctgcttcataccgcctgacaaggtttcgatcggcgttttcttatctatctttaaaccgaccagctccatcagctccgagatgatgcggtccatatcttttggcggaacggatcgattttcaaggctaaacgcgatttcctcatcaacatgaagcatgcaaaactgcgaatccggatcctgaaacataacgccggcgctctttctgcggttgacctcgcctgtgacttcagcttcgatatgttcaggaatgatgccggaaagcacggacaacagcgtcgattttccgcttccgctcggcccgagtatcagcactttttctccctgctcaatcgacagcgagacccggtccaagactgtttcaggacgatgataaaaacggacggaaaggttactgcatccgagaaatgaacgcatcggcatcatccttcttccggtgttctttcatgatctcatactggttcaggactcccgttttcgcaagcgcttcgacaacggcttttgccagccagccgccgagtacaatgccgctgatgatttggatgataagcgtcaatatcagcgtttgcgtcgtatagtaggcaaaaccgtttgccatcaggctgtatgtcgcgctccccaccgcggctagcgcaccggaaagcataagggtaaacaagttatagcgcttatagcgaaagatcgcaaacgcgatttccgcaccggctccctggaacacaccgattaataatgctgaaagcccaaaatggcttccggtcagcagttcgaccgccgcagctgccgtctcggcaatcagcgccgcacccggtttacggatgatataagcgacaatcgggctggcgatcacccatatgccgaacataaagttcgctccgacgggcccgacgatagctgaaacagggatccacaaggtagaccaccctaaataaatgacgccgcatgccacagacaagatgactgtcatgacgacttctttcatgttccaattcatcgtctcaccgcccccatttccacaggccaatcttcaaccgtataagccatctcccaaaagccgtattcaagctgacagctttgcaaaaagagctccttcattttttctttttcagccttgcccgctgtttcggcccattcatccaggcgggcgcaaaactttgtcgtgattgaatccgttctgtttccgtaaaaacagatccagtcataaaatggatgcgatggatcaggctgaacgtccttcatcagtttttttccgatctcccaatatgtccatggacaaggcagcaagacggctaatatctctcccagcgtaccttcgtgcgccgccgtcagcatatggcggacataatgatgggcggaaggcgcaagcggatagccctgcagagtttcgtactccaccccagcggcccggcacaggtttttgtgcgggtgcacttcgctgtctagcacaaatgaaatctgctcatgaaacatttccatatcttttcgattttgacacttggaaatcgcaattccgtagatttgaataaaggcattcaaatactcgtaatcttgctttacataatgaataagctgctccttttccagcctcccggacgccagccccagtacaaacggatgctcaaaaatggcttcaaaaatagggtctgcctcgcggcgaagttctgcggaaaaactcatgtagatagcctccttagcaatcggttttataggaaggcacaggggggcaagcggctttatacgcaaaaaagccgccccaaaatggagcggccttagtatgatgaaatcattaagacaccggctccacttccctacgctagtatgaactagatcaggttcaaagggtccaagatcgcttcttgtctcagccggcttacggctcccctagtggacttcctattacattaacttttactctacacatcaatggttatgatgtcaacctgagtttttcagttttattcttgtatagaaccgccgggtttcatacagaaagtcggcaatcggaaatatttgtagaaaaatataaattttctgaaaccttttccgggcttgttcgtcttatatagtgaagacaaaaaatttggaggggatatttatgatgatgtttatcttgattttgacaatggccgtgtatttgttctattctttcagcaaagacaaccggccggccaaaacaaacaacaggaatcatcagacactgactgttattagggaaaactcttttaccgccccttccaatgatgtcaattgctaacttgatagacaacaagcaagccgcccaatgacgggcggctttttcacgtttttatgattgaaactgttccgcttcagtcgatcccttcagtgcagtggttgatgaagtcccgcctgtcacaacctgggcgacttcatcaaagtagctcgttccgacttcgcgctgatgccttgtcgccgtatagccgtggacttcgctggcaaactcggcctgctgcagatcagagtacgccgccattccgcggtgcttatattggcgggccaattcaaacatgccgtgatttaaggcgtggaagcccgccagtgtgacaaattgaaatttatagcccatttcactgagctgtttctggaagttcaagatcgtgttgtcatccagtttggccttccagttgaacgaaggggaacagttgtaggcgagcagtttgcccgggaatttttcatggatcgcctgtgcaaaccggcgggcttcttcaatattcggctcagacgtttcacaccagatcaaatcggcatacggcgcatacgccaagcctctggcaatcgcctgatcaaggccaggctttgttttgaagaacccttccgctgttcgctctcccgtcaaaaacggtgcatcatatgaatcgacgtcgcttgtgatcaggtctgccgcattcgcgtccgtgcgggcaataagaatggtcgggactcccatcacgtctgcggcgaggcgcgcggcaatcaaattacgtaccgctgtttgcgtcggaagcagcacttttccgcccaaatgcccgcactttttctcagacgacagctggtcttcaaagtgaactcccgcggcgccggcttcaatcatacttttcatcagctcgaacacattcagctgcccgccgaagcccgcttcagcgtcggccacaatcggagcaaaccaatcgatgtcttcctttccttccatatggtggatttgatcggcgcgctgcagcgtgcggttgatttttttgacgacttccgggacgctgtttgccggataaaggctttggtcaggatacatgctccctgacatatttgcatcggcagccacctgccagccgcttaaataaatcgctttcaatccggcctttacttgctgcatggcttggtttccggtcaaagcgcccagcgccgggacgaaatcctctgtatggagaagcttccacagcttttcggcgccgcgccttgcaatcgtgtattcaatctcgagcgtgcccctcagccgaatgacgtctgccgcctcatacggccttgtgatccctttccagcgttcatcatgctcccagctttctgcgagttgtttttctttcagcatcgcacattcccccattatatattttcataagccggtatcgttagaaactccgcgaattcatcatccaaaatcagctgttcaaataactgtccggcctcttcaaaccggccgctccgaaaatgttccacgcctgcttcatcgatgattttctgcatttctttctctttcatcatcttgaccatttccgcggtgactttccggccatcgtcaagaactcctttcggatggcgaatccattgccacagctgggctctggaaatctccgccgttgcagcgtcctccattaagtggtcgatcggagcggcgcctctgcccgacagccatgaagctaaatagcggatgccggcgctgatattggtacggacgcctgcttctgtaattctgcctttcggtacttccagcaagtctttttcctcgacctttacgtctttccgctttctatgaatctggttcgccgacggcatatgctgattgaatacatcgagcgccgtttgaatcatgccgggatgcgcgatccatgttccgtcatggccgtcttttacttcacgttccttatcttcgcggattttggcaaatgcggcttcattgatctcaggtttgtctttagcgggaatttgcgccgccattcccccaatcgcatggacgttgcgtttatgacacgtttgaatcgccaagagggagtaggctctcatgttgggaactgtcatcgtcacggctgagcgatctggaagaatgacttcatccctgttcctgaatttcttaataaagctgaaaatataatcccacctgccgcagttaagcccggctgaatgttccttcaattcgtagaggatttcatccatttcaaaggccgccaggatcgtttcaacgagaaccgtcgctttaatcgtgccctgcggaatgcgcaagtcgttttgcgcataaacaaatacgtcgttccacagccttgcttccaggtggttttcgatttttggaaggtagaaataagggccgcttccttttttgatcagctcttttgcgttatggaaaaaataaagaccaaaatcgaacaggcttgctgacacgggcctgccgccgatcagcacatgcttttcttccaagtgccatcccctcggcctgaccatgataacggcggggttctctttcagctcatagcgtttgccctgttcattcgtaaaagaaatcgtcccgcggaccgcatcccgcaaattaacctggccttcaatgcagtttttccacgtcggcgagttcgcatcttcaaagtcggccataaagactttcgctcctgaatttaaagcgttgatgaccatttttctgtcgaccgggccagtgatttcaaccctgcggtcctccaaatcccgggggagcggcgcgactgtccagtccgcctcgcggatgtgcttcgtttccgccaaaaaacaagggttcttcccttgatcaatttcagcctgcctgatcgtccgcaaatgcagcaattcccgtcttcttcccccgaaatggcgttcaagacgtccgataaactccatcgcttcttttgtcaaaatctcttcataatgcggatttatcgatccggttatatgaattctcttctcctctgttttcatgtctccctacccctttacatgctttgttataaaacagtttgcctactcgccttttttggcaagacagcgctcgcattccatgaagtaagattcagcctgctcctccatcttttcgccgcattcagggcacgtttttttcggaagcgttctgaaaaattccatcggacttttcaagctcatttgtataacctcctttttatagaacagttttatgttttatatttctgttgtagtacagtatacagcgcaaaaatgaaaatgtacacacctttttccaaaaaatatttatttttttccattcaaacaaaaatagattgttctctttttattcatagcttgttcatatttttcttctagaatagggaacataaagaggtgaaagtgatgatgaaaataaaaaacaaacaacttgatgtcattctggttctaattttgttggcagctcttattctgaatacatataacatttggctggacgatgccgccaaccagtattacttggcagcagtcaaaagcatgacgcaaagcttccacaatttcttcttcgcgtcattcgactcttccggattcgtatcagtagataaaccgcctgtcgttttatggattcagactatatttgcgaaaatcttcggcgtgcatacgtggagtgtgattttgccgcaggcgcttgcaggggcgggttccatctatctgctttacgcactgataaagccgaaattcggaaaaggcgccgcccgcatttcagcgctggtgatggcgctgacgccgatcgcggtcgccgtaagccgaacgaataatatcgacagcatgctcgtcttcacgctcctacttggtacatggtgcctgatgaaggcggtcaaacaaggcaggctgatctggcttctcgctgcattcggtctcatcggcctcggattcaatatgaagatgtttcaggcattcatggtgcttcccgcgttcttgctgttttatctcattgcggcccatgcgaattggaagaaaaaaatcgtttcagcggttttatcgcttattgtcctcaccggcatttcgctttcttgggcgcttgcggtcgactatacatcagccgacagccgcccgtatgtcggaagcagccaaaccaactctgtgcttgaactggctttcggctacaacggcactgagcggcttctcggccagacgacgggcaacgcccgcggcgatatgaacggctttggaggagacatgcagcagccgaacggcaatgcgcaagctcagaacggaaaccgttcgtccggcggctccaatggacaaaacggcgcgatgcagccgccgggtgcgggcggttcggcagacggcagttctcaaggggcaaacggcggcagccagcagccagccggaggcggaccgggcggaggcaacggcggtcccggaggcaatggcggcccaggcggaggtcaaggcggcggacaaagcatgaacatgttcggcaccggtgacgcaggaccgctgaggctcttccaatcggctttatcgggccaaatcagctggatgctcccatttgcattattaggactgctcggcacgatcatcacctggtttcgcggccgccgcgaaaaagcaggcgaaatgaaagaaacgatcttttggtctgcatggctcgttcctgtcgccgggttcttcagcatcgccggattcttccaccactactacttgattatgatggcgccgccgatcgccgctctgtcaggaatcggatggtacgcgatgtacggcctttacaacaatcataaagactgggcaagctatctgctgccggcagccgttctcacgacagcagcattccaagtgtacattttaagcgcttatacaaaccaaatcggcagcgcttggatgtatgtcatgggaatcctggggctgggtgtcaccatcgccttactaatgctgaagcgacgccatccattcggaaagcagctcaccatcatcagcttgtgcgtgcttcttttgacaccggtctattggtcggcaacaccgatcctttacggagggaacagcgttcttcctgaatcagggcctcagctgcaaagctccaacggaggcggaatgttcagctcggacgtggacacaggactgctcacatacctccgggaaaataataccggcgaagagtaccttttcgcgacattgacaacggtaaccgcagccacgtatatcatcaatgccgacgaaaatgtcatggcgctcggaggcttcaacggcacagacccgatcctgtcggtcagtgaactgaaaaacctcatcaaaaaaggaagagtaaaatacttcctgattagtgaaaactcaggcaacagcgagctcgtctcctggatcaaagaaaacggaaccgaaatttcgtctgaccaatacagcagtacagacagcttcgcacagcagggtgcaagaggcggcccaggcggcggacagcggcaaacgctctacaaggttgagctgtagaaaatgaggaagcccatcggatgagtccgatgggcttttgattatgcttttctgaaaataaccggcggatgatgttcaatatggtaaaggagtttttctccatatagggtcatcgttttcattcaagcgacgcgagattccacatgactcagctacagcgccgacttgatcactttcttgccgtaaagaacggaaagcaagccgaaaatagagtacaggacggtgtacagcaccatcacgatgatcatcggcgtccacagctctgccccgaataggaaccagccggactggacggcgaagtagctgtgagacaggccgataactaatggaatgccgaagttgtagatttgtttgattcgtatccccttcaacagatcgttccgtgtgaaaccgagttttctcaaaatcgtgtaattcggtttctcatcttcgctttcgtccatttgtttaaaatataggatgcatcctgaagtgatcagaaacgttagtcctaaaaagcctacaataaacatggcaaggccgaaaagcgatttttgagctgtgcttgcatcaaggagcgataaatgctgatcgttttgattcactgttgcaaacagctcatttgcctgctgaagctgatcttcatgttttaaattgattccgtaaaaaaggctcggcttctgctgcagctttggatctttgtcttggctaagacgtttaaacagcgcatcatctacaacggcaacaggcaatccgccgctggtaaagttgaaggataaaagagactcttttttcaagcctaaatagtttaatgggattgtctcatgcctgctctttaccttaacggcaccggtctcttttaaagccataaatttctggagaaggtcggtatatcctgaaaaaatgacgtctccttttggcacgtccatcccggcaatctctgcatcgctgaccacggcgaggggcaatttccccgggtctccagccatattttcaggatctccatcgacaatttgttccagattaaaaaccgcttgaatgacatgaatttcttttttgctgtaggaaatgttattttcgtccaaaagttgttcaaaacgctttgcatccttttgatttgtcatggcgaaatcagccgccacgttttgttcggcggttttctctgcagaatagtacgaaatatagctcaaggataacaatccgatcgccagcgccgaaacggtggtaatgattgttaataatagggcgtttgatttcatccggaacatgatcgatgaaagggacagcacttcataaatattcaagtagcctcctttgcttttgcggatgatgttggagacaaagctgaccgatcctttatagaagaggtacgttccgatgatgacggttccgagaataaagctcatcgcataaaacagctcatctacggtcttgaattttccgctgaaaagctcagtggatacatagtatccggataaaataaacaagatgcccaataagccgatgatcatttggaaaacggatattctctttaccttatcctccgtagctgatgtcactttaaataaagataaaatgctctgctttttgataaacgcataattcatcaccattacgagaaggtagatgccgcagaatacaatgacggtttgcacaagcgcttcgacggaaaaattcaatttggcttcggcttgaacatctacaattttaaacaaaatcatgagcacgagctttgagatcgaaaacccggcaaacaccccaatgaccaaagagccgaaatacagcatgacattttccaagcttaagatgcggaagattttttgcttcctcatgccgattaattggaataaaccgatttctttgcttcgtcttttgataaatatcgtattggcatacaaaacaaacaccgctactactgccacaaggagaatggaagctgccttcaaagccgctgcgccttttatcgatgccttcacttcattgatcgctggatcatactggagcgtaacaaacgcaaaataaagcgctgcgctgaagatcaacgcaaacacataaaggtaatagttccgtatattttttttcaggttgcggatgatcagctgattaatgctcatgctgaaccccgcctaacacgccttgcgtcttcatgatgtcctggaagaacatctgcctgtcctgtccgcctttattcagctgcgtataaatttgtccgtctttaatgaaaaccactctactgcagaagctcgcggcgacgggatcatgggtaaccataacgattgtggcccggcgcttttgatttaattggctcagcttgtttaacaagtctgatgcggatttcgaatcaagcgcaccggtcggttcgtcagcgaaaataatgctcggctcatgaataaacgccctggctgctgatgtgcgctgtttttgccccccggaaatttcattcggatatttatccttcagctcgaagatgcctaattctttcgcgacttcctcaaacttttgaccggcttctttttttgatattttcgtaatcgacagcggcagaaggatattttctttcactgtcagcgtatcgagcaaattgtattcttggaagataaatcctaaatgctgcttcctgaactcggcaagctgtttttccttcatattcgtcatctcagcttggttgatgttaatcgttccgccgctcacctggtcaatagaggacagaacattgagcaatgttgttttgcctgaaccagacgggcccataatactgacaaattcccccttttgaatctgaaggtcgattccctttaacacttcgtgtttattgtgcttatttccatagctttttcgtatttttttcgcttctaaaatcatcattttaaaatctcctttttactggatatttttattatagaaaggaaggcagccgttttccttcgattaagcgaacaaaaaagaaaagcgtgtgacatttttgtcacacgcccagcacacgggaaaattcattccgcattggaaaaatcagcgtaaaggttgtacccgttcccggtttagaatcaacctcgatatgaatcaggagcggctttgccgctttttttgccaagtacagccccattcccgtggcggcctgatcatgatgctccgttgttgatgtaaagcctttgtcaaacacgcgcggcatatcttttggatcgatgccccgtccaaagtcttgaacagcgagatgcactttgccatcctgctcatagcttttaatcaaaacatcggatgcttcgctgtatttcaccgcgtttgtcagcagctgcctaatgataaaagacagccacttcgcatcgctgagcacttcccccgcctccagctgtatatcaaacccgatcccttttggaatgcaccatgattgcaaatcttttatttctttaaagatcataggtttaagctctaggacttcaagggacaagtcattttcgataaatgacatccgcttttgatggagctggcggtcgagcagcaggtggatgcgcagccattcgtacgcaagcctcgcttttaaagattgatcctcaatcgtctccatgatcaaatgcatggcggtaagcggcgttttgacttcatgtatccaggccatgagctcatctttttcattctccaatgccaggcgatgctgtgccgcctcttgctttaactgtttcgtttgttcggctatgcttttttcaatcatcgtttcaaaaggggtttccgcctctcgaatgtttgtcacatcgagattgtggtcccattcttcaagacttttataaaacttcgtttccttccgaaagcggacaattacaaaaacgataaaaataaacgaggacaaataggtcatatacaaaatcgacgtaaaaggaatggatgcatcgacataagcgataaacagaaagaggatctgctgcaaaacaaatatggcgatccagcttcgcctctcggtcaaaaacgctttcagcattctcatcatccttcttctttcgccatatagccctggccgaccttcgtctcgatatattgccccaagttcaaggcatcgagtttttttcttaagcggtttacgttgactgtcagcgtgttatcgctgacaaagcgttcatcgttccataggcttctcatcaattcttccctgctgacaattttgtttttttggtcgatcaattgttttaaaatgaacatttcattccttgtcagttcgatcgcccccgccttattgctgacgcggttttgttcgggatcaacggttgcaccgcaccacgtttttttaagaatctcaggctctgtattatagtcgtagacgcgacggaaaatcgcctggatcttggcaatcagcacgtcaaaatgaaacggcttctgaatataatcatccgctccgaactgcatggacatgaccatatcagcaggatgatcgcgcgaagataaaaagagaatcggaacgttggaacgggagcggatctgccggcaccaatgaaacccgtcatatttaggcagctgaatatcgatgatgacgcagtctggcttaatcgccgcaaactcctgcatcacttcgctgaaatcgttgatgccgtatacctcgtatgaccacccggttaaccgctcttttatttcttgaaacagcgattcatcatcttctatcaacagcagtttaaacatttgcctcaccgcgcttttttctattttctaaatcaagtgtatagcaaattgttttcacgcgctacagagaaaaaaaagggccgtcctgtaaaggacagccattctgtatatcacaaactctcgccattcgtttcgattactttcttataccagtaaaagcttttctttctcgttcttgaaagcgtgccttttccttcattgtcacgatcgacgtaaatatagccgtagcgctttttcatttcggcggtggatgcgctgaccaggtcgatcgggccccatgatgtgtagccgattaagtcgacgccgtctgcaatggcttctcttacttcttttaaatgatcgcgtaaatagttgattctgtagtcatcctggatggagccgtcttcttcgacgacatcgacggcgccgagcccgttttcaacaatgaaaagcggcttttgatagcggtcgtacaatgtattcagcgtaatgcggatccctttaggatcgatctgccagccccattcggacgattcaaggtacggatttttgacgccgccgagcaggttgccttccgtttttgccaagtcttccggactcgtgcttgcgaccattgacatgtagtagctgaaaccgatatagtcgacggtgttttcctttaagatgtcttcatcaccttcagccatttcaatcgtaattccgttttccttaaagaagcgcttcatatagcccggataagccccgcgcgcctgtacatccgagaaaaacagcgttcttctctcattctccatcgcagcgagcacgtcttccggctttggcgtcatcgggtatgtcgtcgttgcggcgatcatgcagccgattttagcgtccggaatgatgtcgtgccccgctttaacggcaagagcgcttgcgacaaatagatgatgcgccgcttggtacatcgcatttaacttgttttcgccttcttcaaacacaaggcctccgcctgtaaacggcgcatgcagaaccatgttgatttcattgaatgtcatccagtattttactttttctttatagcgggtgaaaaccgttttcgcataatgctcatagcaatcgatcactttccggtttttccagccgccgtattttttaatcagaccgagcggcatttcgtagtgggaaatcgtcaccactggctcaatattgtattttaatagctcgtcaaagaggcgatcataaaattcgagtccctcttcattcggttcagtttcatcgccgttaggaaaaatccgcgtccaggcaatcgatgtccggaatgctttaaatcccatttcggcgaaaagagcgatatcttctttgtagcggtggtaaaaatcgatgccttcatgatacaggttcaatgactccatcgactcatcgaatggatacatgacgccgttcggcgacacatcggctgtcgagagtcctttcccgccgacattataggcgccttccacttggtttgcggcaaccgctccgccccataaaaaaccttcaggaaactttttcgtttgttcagtcatatcatttcacctcatccaaatttgtcaggctttcctctttctacgccagcgcgatcagcgcttcctcaatgtcaacgctttcatctgatttcaaaggtttgatcgactggtaccggtccgtatttgtgatgataaccggcgtgatcaactgatagcctgcatccttaatcgcatccatatcaaatgagacaagctcgtctcccggttttacagcgtcgcctttattgacatgcacggtaaagtgctcgccgttcaatttcaccgtgtcgattccgatatggataataatttccgccccattgtcgcttgtaatgccgagggcgtgcttcgtttgaaaaacggttgtgatcgtgcctgataccggcgacaccactttgccttcttcaggctcaatggcgacgccttttcccatgacttctccagaaaatgtcgcatcatccacttcactcaatgctttgacttcgcctttcagcgggctttgaatgatctctcccgcgcccgcttcagatggagcggctccttgttcagcggcttcatctgaaggaatgtcttcaaaccccaatacaaaagcaaacgccgttgcggcaaagaacgcgatgacgataccgatcattgcctgtataaaagtcgggccgataaacgtcgtaattcccggcaaaccgacgtttccgccaataatatatgctgctacgccggtgatgccgtaaaatgctcctccgacagcggcgccgagaagcgcggatacaaacggctttttcagcctcatgttgacaccgtacatcgccggctctgtaatccccatcaaagccgtgatgcttgtcgtcagcgacaatgatttgaatttcttatttctggatcgcaggaagacggcaaatgacgcgccagcctgccccatattcgccaagaacatcgcaggtatcaagtaatcgtagccgttttgcgtaatgttgttgaacataaccggaatgaaagcatagtgcattcctgtcatgacgatcagcgagaacgttcctgctaaaaggatcatcgtgattaaaccggcattttcaaataaaccgttcacaccgattgacagatagttccctgcaatcgcaccgagcggaccgaccgtaattaatgtgacaggcacgacaaccagcagcgtcagcgtcggtacaaaaatcatcttcaacgaagtcggggtgactttgtcaatccatttctcaacgtaagatgcaatccaaatcgcgagcaggatcggaatgacggtcgacgaataagtggcagcggttacaggcaatccgacaaaggaaatgcttttccctgaaccgagaagcgctgtcagatcgggatgcagaatcgccgctccgatcgccgccgcaacataaggattactgccgaattttctcgcggcactgaccgccagcaaaatcggcaggaagtaaaatgctccgtcgccgatggcggataaaatggtgtggacctggctagtttcgctcatccagccgaacgtgacggcgattgcaatgatccccttgatcatacccgctccggcgatcgccgggagaatcggcgtaaatacgcctgatatcacatcaaaaatggcggacagcacgtttttctttttgccagcttgctgctcgcccgctttttcatcgctgagcccgctgttggcaatgatcgctttatacaccttagggacatcatttccaatgatgatttgaaactgctggccgctgatgttggtgcccattacagccggaagactttccagtttcgcgcggtctgccttcgcattgtcataaagattgaaacgcagtcttgtcatgcagtgaatcacgctctgtacgttctcttcaccgcccacgagttgtaaaatgtccttcgatactttattataatccatatgagtacctcctctttgggggaatctgccggactgaaggtggccgccttcacccggctttttttattggcctgctgccgaaagaatcctcgaaatctcacatcacctccttattttgggtataaaaaaaacctaaattacgccggcttaaacgggacaatgccccagaaagctgtacgcaacttaggttttgcctgcaaaagcagtaacaatccttaagaaacttgctgatattagtttgtaactatactttagcacccgtttttgttcatgtcaacgctttcattacaaatgtctcataaaaaatagaatacatgaaaactaaaaactaagactttataccttcatttcttcgttttctagctttcgccgcctttttcataagcaatgcagggtttcgccttgctttccttcgcgccgccggctctacaactgcttctttcggttcctgctgcttatgaagaatgaatccggcagccataaacggaatccctgataagttcgtgaaaatgtttttaatgcccatcgctaaaataaaagatccccatggagaaaacggatcttttttgatttttacgtaagcggcgatttccaaggcaataaaaatgatcgactgtgctaatatcactatcagcaagcccaaaatgaacaagaggcccaaattaaataatgtgcctgagtagagcatcaatttcagcgcagctacgaaagttccagcctccatatatccgtccgtgacatttggattccaaacagcataagcgtcaagctgatgtttgaaatgaaaaaacaaaaataaaatgaacaaccaatatatgctatgtaaactgatgcctaataaaatgagtctgtctgctgctttgttttgcaatgttgctccttctttcgtttatgattgaagagaatgaaccgtctcttcctgctttggctgaaacgcctttaattcgttgctgtccaggtcttcctgtaataagcaaaccttttgaatctgcctgttttgataatggtgaaaatagtagctgcacgtctcgctgcacattaccgccgtatattgggtgtaatcgtcttcgccttgatcagtcataacaacccctttaggaatattcatattggagaggacatgaaacgcggcagagacgccttctgtttcatcggacacaggcttcatgtgctctttcaaaaatgcagccctgacaaagcgggatggcggcgtaaaatctcctggcaatccggacagcccggaaccttgaccaaaagccgacagcgtcaggcctcccatttttttcgcggcaaactgtcccggctgaagaccgataaagttgcgcaaattggtcaaatgccaagggaaatccggactgttcgtcagcacgccgaccggattatcatgaatttgaatgccgtctgccgtcggttcaacaacgacgcttgccccggagcggtccgttaatagccaatgcagcggcgtcaccgtactcagcaagctgacctctctctcaacaatgtttaaggaaacagccgcttttttcacatcctccaaatcgccgcattccgacagcacccatgtcacgaattcgtgcggcgcaagattgcggctttgctcttttgcttcgttttcatacacagcatagcccgggaaataaagcgccgcgcaagacaatcctttttcattcacaccatcggcaaacagagcattcttgagccttctgcccatcccgatatacgcataccggccggcatgctcgctgccgtccgcttcacttttccatttgtagcgacgcggatgcaacagcacctccccgttaagctcaaaatcaaaatccatcgtcctcgccaataaatgctcccggcccgcagtcgtcaacgtgatacttgtacacattgcgcttcatcctttttgtttgatattacacttcgtgaactatttttatgttatcgaattggaaaagattcgtcaaaatgaaaggggttatagaaaaaagccggggttttcatcccggcacataaattcattcaacaatttttcttttttctttaaatttagtataatcatcaactatactttttaaaagtcgatctatagctgtaaataccgtaaggattaagaacatgatatagtcattagcagaatcagcaacctctaaccctattacaattttaaaatcggaaaaactttttgaaatggttataatcaacaataacaggtacccaataatccttctaatattttgttcttccgtattgaaagttgaaaagtaaatccaacttgctaacgttagaggtagggtcaataaaaataaataaaaaatactataaggtatactgttaacttcggttaaaaaagttaaaattaaaattaaaaataaacaatgaaaatacagactcattcctgtttttccaaaaaacacttttaatctatcaaaaatataactatttctattcactttagagatagtattttcaattaaactctcgtattctttttgatttttttctaattcttttttaatatttaaattaaaatcccctataaagatagtacaaaaaagaaagaaagctagtaatccaaaaaataaaaaattgagaagagagttgcttggtgataaaacacaaaataaacttacggcaataaagataatcattaataaaataaaaaagtactcactagctctcaatgtctttttataaattaataaggtatttttttgttcaacaaactttctaaactttttaaagctctccttactcatgtatttgatagaaggaaatataaatttatcaagaacaaagttagatccaaactttactatacatgcaataataattaataaaataagactcatttcatctacctcgtatcaaaattaaaggtgtataccttctacaggttggagacccttagtctttttaaaatccaaactagtttcaaagagttgaagagtatcaattggtttaatgtaattaatatttaaagccatgaactgctcttttttaaatttaacgccaaagatagtcattgttttctcatgtccatccactgtatcaattcttttttctaaaacattaatcgatacagtctcaacaggaattatttgaaagattacttttgctaaacctatagaaagactggcaataaagtttaattggttttgataatattttgttttggttagctttttagttaacaagttcccagcagaagagatgtattcttcttgattcggtaaaattgatgtgtccactaatagattcaataaaacttcactattttcattcgaaataatctcttttatttttcctatagtatcttcaatcttaataatatcttctaaaatttcactataagcaacactgtttttgtcatcaataattttcacaaatttttgttgctttacccactcatcatattctttcttatatttagtttctgcatcagtaatttctttatttaacttttcaatttttgttttatctaatctaagaattctctcaaagaaattgggtttataattatttaaatcactttttaattgagctacattaatctctggcggtgactcttttttaatttcttcccaatttatttgcctgctcgttaatctcgtatgaaatgaagttaaatgattgaggtaagcattaagctctaaattatttgaataattgttattattcaagtgactttgtttttgtgatgaagaaatagatttactggaactataagatagacctgtaccggggatttttgaacttgttgttactttgccagaagtattataagttatcctgccatttttgccccctaaagtcatcccaacactttttttatttatattaagtttgacaccaggcattattttaaaactccttttaaaacccattttatcaacaccccttgttgatttttcttcatagaatctcacgaacaacttatgtagtaaaaaagaccatatatgtattatcgtataatccatcctgaatttccatattaaaacaaccatttgatctaaatcatttaaaaagcacatacctttaatcaggaatgtgcttttagagatgaaattccttttaaaattccgctctttttaaactactcccccaaaccgcatctccctcacgagacaacgcactaaacgtcatcaccttacgctcagaagccgcatcccactgacgcaaaaacacgccatcgtaggtttttccgtcgatcttgagttctattttgttatgccccgtgttcttccacgttccggctactgcgcctgttattttgccattttgattcaagcggatttctttcgattctttaatatctgcggagatgtctttgccatgacgcaccaattcgtaggcgccaatcacatctgatgttttcaccttttcgagcttttctccggcatagcggtgaggggcggcaacctgccagccttgtttgttcatcaacagttggtggacgcggacttcgtgctcctcgccccttcccgggaagcgggtgtggaagattaaatatgatttaccgcttttttcatcgtaaaaggcagagttatggcccggcgacacatagccgtttttattgttaaatgagaaatttcccatcagtttgacgccgtactgttcgattgaacgatcgtcaaaaagcgttccttctttgccgcggacgtcaatcatcgcgtggccttctgcatcataataagggccgtcagggtttttggagcgggcgacgcgaatgttgtacccgccgtcagcggcaagccccccgaaggacatgtacaggtagtaatactgtgtttcaggatggtagagaatatatgcgccttcaatacggctgtggttgccgccgatcagctttttgccgtatccctgtcccggaagcggaaatccggttttcttgtccatttctaaaataaaaattccgccggaataggagccgtacaccatccacagctttccgttttgatcaaagaatgtgtggggatcgacgacatttgggtgctttgtcgcgtcataaggcgtcccgtcattgctgatcccatccattcccgacttcagaaaaatgcctttatttttgtatggaccttcaatgtcgtctgcgacagcaagcccgagggcggatctcggagaatccccgcggcaggcgttgtaatacatataaaacttgccgtcctcaagctgggtgacatcaggcgcccacaacgtatcagattcagcccattcaaaggtttcttttaattcttcatagacgttcggaatcagaggattgccgtcgtggacactcgaggaaatttgcgtccaattcatcaggtccgtcgatttggccgaagctaaatgggagccgaacacatagtacgtgccattcgctttaataatcgatggatcatgtaccgtcacttctgaaaaaacaggtttttgagtttgtgcagaggcttggtttggcgcgaaacatgcagccatgatgaaaagcaatgcaaggacttggatgaaacactttctcatattcatttgttctcctctcttttaaaacgctttcattttttgacaatccatcatatgctgcttatccaaggtttattacgagcaaaaaagctcccgacaaaatcggcagcctaagattatttcctcgctttatgcactttcagcaatttccctttcacggtcgtgtttttcatcgcatctaagacgagcggacctttgccgtttaaaatttcaacgaatgaaccttgctcctggatcgtgataatcccgatatcctcggcggagacgccgtcaattttagcaatcgttccgacgaaatcaacggctctcagcttcttcttttttcccccgttaaagtagagcctcatgatttccttatttaacgattcgctcttgtcctttttgagatccggcttcgcattgattttctttagaaaagccgcttttgctcgtgcaatttcttcttttgacggcgcttcaataataggaatgggaaaaccgatatagtcttcaatgtcagcgatcatccccttttcacgcggactggcaagagtaatcgcttttccccggctgccggctcggcctgttcttccggtacgatgcacatagctttcttgatctaatggcagctcatagttgatcacatgtgtgatgttctcaatgtcgatgcctcttgccgccacatctgtcgcgattaaatagcggaacgctccccgtctgaaacggttcatcacggcaaaacgatcctcctgaggcatgccgccgtgaattttctcgcacggataacccaaaacggataggcgccgctgcaactcattcacttgctcctgtgtgcggcaaaagacgatgcagctgtccgggttttcaacaatgaacagatccactaaaagcgaaaatggatcattttcgtttacaatgatcagttgatgctcgatgtctgcggttgtcgtaccgcctgctttaatctcgattttcaaagggtctttcatatattgaagggatagatgctccacatcctccggaaaagttgctgaaaacagcatcgtcagccgttcttcaggcaaatggcggatgattgctcccacttgatcgataaatcccatattcagcatttcatcggcctcatcgatgacaaggtatttcagtttttctaatggaagggttcctttttcaatgtgatccaatacgcggcccggcggcccgacaacgatatggcatttttgcttgagctccgttttttgccgttcaaaggatgacttcccgtaaacagccgctgcttttattcttttatagcggccgatgttcgtcaaatcctccttaacctgagcggcaagctcgcgcgtcggtgtcaaaaccaaggcttgtggtttgttctcttcccattcggtcaactcgcaaagcggaattccgaacgcggccgtcttcccgctccccgtccgcgatttcacaacaacatcccgctttttaagcgccgcgggaatcacctcgctctgcaccgcagtcgggtgcttataccctaaatgatcgagcgctttcgtaatatcgccgcttaatgcatattctttaaaactggctttgctcatgtatggactccttttggtcatatgatttccagtgaatgatggtgttatgaatgtgattatacgcgaatcatgactgatttcaaaaagacatgaaaaagaggctgcaatcagtgcaaccctaagaaacaccctacagtatcaattgttttcaaaaattaatccgatcatagtaagctcccacagcaaaacagcgatgaaaatgacgcccagtagacgctgtaatacaaaagggaggcgggctaaaacgatttggacttcgtaatttaaagaggaaaccagaatggctacatatcgaaaaaagtcggtgatcagcccatttgattcgtcatatacgttgacttcatatagcttaatgattaatgttggtacaaacaaagaaacaaatgcaaacaccatgttaattgttaaatatatgataagcgcagaattgggatacggtatatcccctgacatcgcaaatccaaaaaataaactaaaaatagaaaaaacaaatatacctattgggatattggtctttcttatagctcttgaaggagggcgcgcaattgtcttttttgtttgaaaaccatataccaatgcaagtaaaatgataaacagctcagcagtgcaaacaaacataaaaaacataacattggcgtttttttcccaataaggtttattcaacaacaatagagcagttaacaatattagaataacattgcttctcagccaaaagaatcggctttttttaaaagagaacataaatagaaatcctttctactataaatcataaaattcattcattgtatccactattttcccaaaatattcgtcgactgccactggtagaagatatagcgagccagtttttttaatattttcataatctaaatgccaaatgaaattatcacttcttaataaaaaagcaacttgatctaatcttgtttgattttgaatatagtcactttctacaaaagaaatattatcgagctcttggttgtttgctaaaaagtcaaaggaaaattgacttatagtcggatgcgttttcgggtcttccgccattcttttaataacgtcagcttcaacctcgtgaaactcatcaaatgaatcttcatccatttcaaaaatttcatgttctggttttttatctgtatatgaatgataaaatgttttcaacatttctaaaaacgactctctgcttcttaaaatcgaaaaactatgattttgattttcgatctcctgcacaatgagttcatctttttgaacatggtgtacaatcagcacccttttccgatggatacaacgaacttttcgctttgattgaatgagtaagtgaatcaggttttctaaccctttttgtaaattagattctgtgccatcagcccaataccctctttgttttaaaagattttcggcttgaattgaaaatggctcaatatctttttcatcttgaatcaactgctgatcattgataatatcttcagcagctttttcatacctacacaataaaaatgcggcaacgagttcatttgttgttaatataattttagagtctaacattatactcctccttattacctgaaccagctagtgacaaattcctttgcacctgagagtccgtctgaaattgtatctgtagtttcagaggccttttgacttaaccattcaccagcttccttacctttatcttctatccaacctgcagcatcttctccccattcttttacttgatctcccgcaattatggatccagttataccaataccagctccaattgctcctccaataagggtgccaggacctggacatactaatgaacccagtccagctccgctagcggtcaacgctccaactccagcatccattccaatccctgctgaaaatcggccaaatttttcgaaccaagatttatctttattatcatcactaaaaaactcagctccatttgtagtcaaggagaatattgttccagcataaggtatttttttggcgagttttgtaatactagcttcatccttaaacttcccaacagtccctttcacatcaaccttagtcttataactcttcagttcctctggcttatgctttaggaaactttggctctccaaaattttcttgtaggagatccttgttgtgttaggccccaatccaacaatctttctcaaaaggccgcttggtttattttgaaatttgccgagccatttttttattggtttgcttgagtttggatcgccttttttcaggatgttgtaaacaaactgagccaccttggaatcgtattttccgttagctccttgcgtccatttcggagaggctttcacacggaagtttccttttccgtctttttcaagctcaagcattttcgtcgccagtacattcacggctatgacgccttttgttacggccaacgcgccgtttcctgttccgattaaatcaagccattcagcgattctgcccatcattgtcggatcgtcttgtttttctgctaaatcaacggcttcgtcaatcatttgtttaacgacatctgtttcagaaaagtagttttcaacctctttaatcgtttttttagataagatcgcgcctccctttgaccaagtgttcaccttttcagtgagcttggatagctgagcgatcgaatttgacgattgttttaatatagaattagcatcgcgatcaagctcttttaaatcagacaccgtgttgttcacatgttttttggcttcggaaatatgctcattaaatgatgccaaagagatagatccgcccccaattaagtggctgattttatcaacttcgtcattaatcgaatcaaccgtatcattcgtttgacgtttcagttctgttaagccctttttgacgtcatgcgtcagaaattcttcttttacaaaaccctctgttgattcataagttctgatttttgctttaatgtcttttaaattctgtatgtattgatctataaagtgctgaaaataaagcagcacgggaagatgaagaacagaaaagtgttctttgatcgcatttccgccttctccttttaatgcatcatcaagctctgcaattttttgtacactttcccttatggcgttgatctctttttcctcctgctttttttccttaatcaattggtcaatcgcgtcaatgacttcagaaacatctaaaactttcaagagaaaaccagccctccttatttcattttttgagagatgtttttatcagtatcaatcaagactttaatgtttgaccatgcgtccttttcaactgatgatagcgcctccttgtatttttttagtagttgctcgtattccttttcgattttttttattttgttcactacatccattgaagaattagagatatcggcttttgaacctgatatcgaaagtgcgctgatttttgtctgaaggcttgaaaacaccgttttgacttcttctgcttttacctttatttctgccattatttcacctcaatgattgacttgtttttttatatctgtaagctgttgtttttgtatacttagaaacatctccatattagaaatttgcatttcaagattttcaatctcttgctcaatatgcgaaatcagaccatctgtttctctctgtatattttgatagctgtgtgcaatgtttgatctaatattgataaattgctttgtatgtctgccattccatatatgtgatgtaatatctggctgattgatgagagtggcattgtttgaaagggtgtgaagttcaccggtaatagctgtttttgcttttttcagttcagcgattttgctttgggtatcctttatattgtgagataaagaagaaatatctttttccaaagaagagattttagcagcatggttagacatatcgggttcacctcatttttcagaaaataaaaatccgcacgttactattcgcttattccactgtatttcggttaggtatattgttgctttacgggagaatctaacgttcttgtaaatcagacctttttcatattacaatatcatccaaaataggtaaataggataatggacttggttttcttggattttcttgaatcgatcaattcaagatacaaacgatgttatttaaaatagcgtcctggacttagttcaaatgaccttttctcaaattccgtgacatcaaaaaaacagcacacacccaaaggtatgtgctgttttgcatgttcctctattccgtaatcaccgtatgcacaagcttcggtgcttcggctgtttccgcgatttggatgttgtcgtagacttttgcgatgacgtcatcgacattttcgcggtttgcgtatagggtaaccaatggttcgcctttttcgactgcgtcgccgacttttttgcggagcatgatgccgacggcgaggtcgattttgtcttcttttgttgcgcggccggcgcccagcagcatggccgcaacgccgatttgatcggcgacgatttcagacacgacgcccgcttctttggcaggaacgtcgattttataggcagcctgaggcagcttttctgggttatccgcgacagagctgtcgccgccttgattctgcaggaagtctttgaatttttgcagcgcttttccgtttttcatcacgtcgatcagtttctctcttgcttcgtcaagggtctccgcttttttggcgagaacgaccatttggctgcccaatgttaagacaagctcagtcaagtcttcaggaccttcgccttttaatgtatcaatcgcctctttcacttcaagcgcatttccgatggcaaaccccagcggctgggacatgtcggagatgacggccatcgtttggcggccgacattgtttccgatgcggaccattgcttttgcaaggttgactgcatcttcatcggttttcataaatgcgccggcgcccgttttgacgtcaaggacaatcgcatccgcccctgcggcgattttcttgctcatgatcgagctggcaatcagcgggatcgaattgaccgtgcctgtcacatcgcgaagggcgtacagttttttgtcagcaggcgtcaagtttccgctttggccgataacggcgaccttgtcgcggttgacgagctcgatgaattcatctttggaaagttccacgtgaaaccctttgatcgcttcgagcttgtcaattgttccccctgtgtgtccgaggccgcgtcccgacattttggcgacgggtacgtcgagagccgcgacaagcggtgcaagtacgagcgtcgtcgtgtcgccgacgcctcctgttgagtgtttgtcgaccttgataccttcaatcgcggaaaggtcgatcgtttcgcctgagttgaccatcgccatcgtgagatcggcccgctctctgtccgtcatgtcctgaaaatagatggccatcgccagagcgctcgcttgatagtcaggaatgctgccgtcggtgtagcctttaatgaaaaattgaatttcttctgttgtcaattcttctccattttgtttttttgtgatgatatcaaccattctcattgtgatcaccagtccttttttcaatgtttatcaatagatcaatcctacaacggtcgctgtcaagaaactgacgagcgttgcgccgtacagcaatttcaacccgaagcgcgcgacgacgtttccttgtttctcattcagtcctttaaccgcaccggcgataataccgatcgatgagaaattggcaaatgagacgaggaagacggaaacaatcgcttcggtgcggccgctgaaatggaagctgccttgtgcgagagactgcatcgcgacaaattcatttgagaccattttggttgccatgatacttccagcattcaccgcttcatgccatggaatacccatcaggaaggcaaacggcgcaaaaataaatccgagcagttcctggaatgatatacctagtgcggcgctgaaaatgccgttaatcattgcgatgatcgcgacaaatccgatcagcatggcggccacgacgacggcgactttaaagccgtccataatatattcgcccagcatttcaaagaaggattgtttttcctcttcctgtacctctaccatatcatgttctcgatcgacttcataaggattgataatcgaagcgataataaatccgccgaataagttcaatacgagcgcggtgacaacgtattcgggcttcagcatcgtcatataggcgccgacgatagacatcgagacggtcgacatcgccgaagcgcacagcgtataaagtctgtgtttaggcagcaggccaagctgcttttttaacgaaatgaatacttcagattgccccagtatcgccgaagccacggcattgtatgactccagtttgcccatcccgttgattttgctgagcgcaagaccaatatattttataataaacggaaggattctccaatattgcagaataccgattaaagcagatataaaaacaatcggtagaagtacgctgatgaagaatgtggattcattcacattcaccagtccgccaaagacaaaattcacaccttctgccgcatattcaagcaaatagccgaagcccttggcaaaaccgccgacgagatagtttccgacacccgtgttcagcaatatatatcccaatgcgaattgcagcacgatcatgacgataaccgggcggtatttcactcttttctttccgctgctgaccagccatgcaagccctaagacgacaaataaaccaatgagcccgatgagatatttcatgttttgatcctcctggtgatgtattcgcttacatttttgtatctgcgcgcaggaagcttccgcttcccgccgcactggatcttagtagttatcttcattttttccttctgctccgctgacgatggaaacgcctgcgcttgcaccgatccgggtcgcgccgtttgagatcatggtttcaacgtcctcttttgtacgaatccctccggatgctttgacaccgatgtcaggtccgacggttttccgcatcagggcgatatcttccgctgtcgctccgccggttgagaacccggttgaggttttgacaaagtcggcaccggcagcaacagccaggcggcaggcgcgctctttttcttcgtctgtcaacagacacgtttcaatgatgactttaacaagcgctttaccttttgcggcttcaacgaccgcgcggatgtcggcctcgacaaagtcatcgtttccgtcttttaaagcggcgatgttgatgaccatgtccacctctgtcgcgccttttgcgatagcgtcttttgtttcaaacgcttttgtctctgtcgtgttggcgcccagcggaaaaccgatgaccgtgcaaacgtcgatttccgttcccttcagctcttcggcggcaaattcgacccatgtcgggttgacgcagactgaagcgaattggtatgctttcgcttcttctattaatttcttaatctcggatttttgtgtatgcggtttcaatgctgtatgatcaatgagatttgcaatcgtcatttactagcacttcctttgtataagatagtttcagcataaccgatttttgaacaaatgtaaattatcatatgaaattttgttcaatagaaaataaagtaaaatccaggctgttcttcctggacacttcagtcatcaagcagttctttcgccgtgtgctgatcaataatcagcacattggcatacttgcctttgagcgcaccatgaatagcggcttttttccggctgccgcccgctacgagaatcgaccgttctttttccctcaagtcagccaattcaatgccgatcgtccgcgaatcgatagcatcgctgcaaatgtttccttccgcatcaaaaaagcgcgaacaaatatcgccgactccacgttctttcaggagggctttttcctcttcatgaaaataccccagcctgaacagcaaggcttcatcgcgtaccgtgccgactgtaaataacgcaatgtttgcctgttttcccatttctatgatccgcttgatgtgcctgtcctgttccaccatctgtttgacttccggattgtcaaacacgaccggaagcggcaaatacctcggcatcgtttgaaaagcttcggcaaacagctgaatcgtttcagacgaataagtgttgacgctggaatggctgattccgcctttcagttgaacgacctctgcgcccttcacctgtttaggctgcatattttgggcgatttggtacatcgtcgtcccccagctgacgccgacaatgtcgccgtccttgactgcgccgtgcatatattcggccccgaagcggctgagataatgcgtgatggtcgtataatccgcggtcggcgaaaagacaacatgcgcttctagaagcccgtatttttcctcaagcatcgcaccgagcgcatccatatcttcaaacgggtccataacgcggatttggacataccccttttccttggcgaactgcagcagccttgataccgtcggtcttgaaatctgcagctgttcggcgatttgctgctggctgtagtcagactgatagtagagcctcgctgcttcaatgctcaattgctgtttttccttgtccatcacgttcctcccctttagtaacgctttaacccatattatataggttcatgctccttctcatccagctgaattgcaaaatacggtccgtatgcagactcatgcgtcaccgcatatgtccatgtcatatgtttatccgttatatatgcatcttcttctcctttcagatctgcggctatcagttgttcagcatgttcaagaatataggcgtcatccgtgtgctggtagaataaaaagcaatcgcgcttcggctgttcgctaaaggcttgatcggcctgtccgccggtaaaacacggcttcatcccatagctgaataaatgccacaaaaaatggctcaccaagatcgcgtccctttccggaagctccatgcttgcggcaaaacggttttcccacgtttttctcaagtaagagccccacttcggtatttctgtcactttcacattttgtctttcaagcttgctgatgatgtacattcaggccctccgtttattttatttttccaagcgctagcacacccgctagttctcttctacatttccccttttaaaaatcaatacgaaaatcctgctattgatggaaaaacattttattattggacttacgtcctgtttttggatagtccaaaaagatcaaataaatctagcaatctccattttttcatttataataaataagtcaaaatcattactcaaaaaaacattcggggtgatctatcgtgaaagcacccgtgaggtatatatggattggtatgatcctgtgctttttatccgtcagtctggccgtcggctgtatcaaagctgaagatcagtcagatgatgagaaaaatgatgaagcgcttcagcctgccgaacacttcgtttaccgtcatttaatgagcgatcaggggctgatcaaaaccggcttttccgaccagcctgtttacttgtcggaatcgcttggcttgtggatggagtttttgatcagcaaaaaagacggcgagcatttccatgagcaatatcagcacctgaacgaatccttccttatgaacaacaacctggtgtcatggcaaatccaaaacggtcaggcaagcggggtgaacgccctgatcgatgatctcagaatcatggtgagcctcgatcaagcggcagctctatggggaaacagcgagtataaacaaaccgctcggaacatcggtgccgcattaagaaaatacaacatgaacaacgggatattgacggacttttacgactccgcctctcaatccgcggcaaaagatatcacgctttcctatatcatgccagatgcgctatccatcttgaaaaagaatggagtgataaataaagaactcgaaagtcggaatgccagcattctttatcgcgcccctttgaaaaacggttttctcccaaaagcatacagtacagaaacgaaagcatacacctatgaccatgaagtcaatctcattgatcagctttacgcagcttggcatttacctccgaaggatcaaaaagccgctgtattagcggattggctcaaacagacgtttcaaaccggcggaaaactgtatggccggtattcgctcgatacaaaaaagccggcggtccaatacgagtctccatccgtttacgcgttggcgattttattcttcatcaaccaaaacgaagataaaaccgtcattaaagcgctgtatgatcgaatgaatgattttgaaattcttgattcgtccgagacgtattatgggggatatatgagcggaaatgatacgcattcttttgataatctgctgcccctattagccgaaaggaagcttttaaatgaaaatctcattcaatgaatcgcataaaatgttcgcttatatgacaggacttgcagcagcgcttgcgttgttcatccattatatctcagtccagcggttcgaacccgttctcatcatttgcatcacacttgccatcatcgcagcaggaatatggctcggatcgatttacgcactggctgggaccatcatcgtcctgtttgttctcggcactttgatgatgttttttcacacaggccaaggagaagctgcttcgtctgaaaccggactgcaaatgctcgtcatctggggagtggcgctgttgctgttttcctttatgtcagggagaatacacgacatcgcgatcggacttcaccgctccgtcaaacaccttcaagacgaaatcaaaagctttgttgcgattgacagggtgacaggctttgataataaacagaggatgaagctggagctgtcagaagaaatcaagcgggcggagcggtatggcaactcgtttgtttttttactgcttcatatgcattatttcaaagagttcaaatccctgtacggagaaaaagaaaccgatcgtctctttcaatttgtcagcagtcaaatcagatcatgtgtccgggaaaccgataaaaagttccggcctgccgaggagcggttcggcatcctgctgacacacacgcctgccgaacatatgcccgccgtccttgaaaaactgaagaaacagctggatacgtaccagctgaaaaacggcaagtatgtcaccttgaccttccacgtgtgccacttatcatatcagaacgatttaaagactgccgatcaatttttagaagaactagaaaacgagatgatgatgaatgaactgtaagcggctattacttctatacgcggctgtgcttatcctgtctgcggctttttatgttccggacagcgccgaggcaaagcagcaggagcacggcattctcatcgtctattcaacattggatggaaaagagtcagccgatgtgaaaattctcgaccttatcgccggccatttttcatcccgtgtggccgtcataaaagacgcggatgtcaaagcatcggatctcgcaacaaaagaccgcgtcatctattacggacaaacgaaaagaaagctgagcaaaaagctcgcgcagctgatcagctcctccaaaaaacctgtgatagcgatcggctttaacgccgggcagttcagccaatttgcaggtcttacgctcaaaagcaaagacaatgtgtatcagattcgcagcacaaatgaggaaatcgattcctctttagaaagcggagtccgtgtcctcgacgtatcaggattgaagggaaaagcattgtacacatacaaagctgacgaaggaaaagctcgtccttttggatggaaaaccggcaaaggaaacgtgtacatcgggttaaccgatttgctaaacaacagcctcctcgccgctaaacagctcagacaggcatttggtgaaacggccggcagcacgctgttatatttgcggcttgaggatatcagcccgatgtcggatgaaaaactgctgctccaagccggatcttatctgcataaacggaatattccttttatcctttctgtgattccggtatatgtcaatcctgaaacaggcgacaaagtctatatgtctgaaaagccgaagctggtcaaagtactgaggaagcttcaggatatgggcggaagcgtaattgtccacgggtatacccatacataccgctacagcgaaaccggtgaaggattcgagttttgggatgccaaagccgatcagccgatcacatcggaaaatgcggaagaacccgcgacccttttgcaaaaggaacagagctttccgaatgaagaggcatatcaaaactatttgaagccgttcagaaagaatgaagaaacttacacgcggcagaagctgacgaacgctattgaggatctcaccgcggaagggctgtatccgctcgcgtttgaagcgccgcactatacgatgtcagagcacggctatcaaatcgcctcacaatatttcacaagcttgttcggccaggttcagcttagcgatacaacatggaaaacgtcaggcgccggtccatttgttacgaatccggccatgctccatgggatgacgctctatcccgagacaatcggctatgtcgatcaatcggagcaaaatccgctcggcaaagtcgaggagcgcatctctcaaatgatcgattttgaaggcggagtagccggcgcattttatcatccttatcttggaatgaaatatcttcctgaactggttgatcaaatggaacgcattccaaacagcgaatggctcgatattaaaaagacaaagcaaactgttaacacagataaagtagaaattcacacaagcggagatggaacgattcaagtcaaaagcaaagtcagccccattgagacgtttttcgatcatcaccagcaaagcccgctggaaaaggcgctttggattctctctcttattgttctcttgtttgttgtcatgtttgtgagctataccctttacttgagagccacattaaaaaaacgaatctttaaggagagaaaaagccgtgggtaatgttctgttcctagtctcgttaagcttaatatgggtcatgcttctgtatcacatgtttttgatgcagggcggattccgccactatatgaccttcgaacggaacattccgaagtggaaagagaacgtgaaggatctcccgaaggtcagcgttctgattccggcgcataacaaagaggtcgtcattcggcagacgctgaaggcgatggtcaacctctattatccgaaggaccggctggagattattgtcgtcaacgacaattcatccgaccggacgggtgacattgtggatgaatttcccacgcaatacggctttattaaaatggtcgtgaccaaaccgccgcatgccggaaagggaaaatcgtcggcgctcaactgcggttttgccgagtcaaacggggacgtcatttgtgtatatgacgccgacaacacgccggaaaaaatggctgtttattaccttgtcctcgggctcatgaatgatcagaaagccggagcggtggtgggaaaattccgcgtcatcaatgcggcgaaaacattgctcacaaaatttattaacatcgaaacgatttgttttcaatggatggcacagggcgggagatggaaatggttcaaaatcgccacgatccccggcaccaatttcgccatcagaagaagcattatcgaacagctgggcggctgggatgataaggcgctggccgaagataccgagcttacgatccgggtctacaacctcggctaccacatccgcttctttccggcggccgtcacttgggaacaggagccggaaacgtggaaagtctggtggcgtcagcggacaaggtgggctcgcggcaaccagtatgtcgtcctgaaatttttggctcagtttttcaagctgaagagaaaacggattatttttgatttgttttatttcttttttacgtattttttgtttttctttggcgtcatcatgtcaaatgcgatttttgtcatcaatttattttataatctgcatctttcattcggttttttgtctatcattttatgggttttggctttctttctatttatgacgaaggtcatgattacactgagcatcgaaaaaacagaaatgaacaggcaaaactttttcatcgtttttctgatgtactttacatactcgcaggcttggattgtgctcgtgatttattctttattcgtagaaatcaagcaccgcctgttcaagcaacatggtacaaaacagaacgatacaatcaaaagaaaagcgggtgacttttttgaaatatatcatcatatgtctggcaagcttcttgctgatcacggcgacgggacaagcggctgcagccaaagacgttacagtagacggctcgatcctgggggaaaacagccgggaacaagccaagcagcaagtgctcacaaacgatctcttgactttatacggggcaaaagacagcgccgagctgacgtatcaaataccggcgggcgcctcctctacccatcagcagcttacacttaaatacgaggcctcagaccttttaatctcaccgtcttctttaacagccgagattgatggcgaaccggtcaaaacggttaagcttgaagggaataacgggaagaaaacgctgaagctctcgctgaacaaaagccagtcgtctccagggtttcacagcttatcactgaagttctacggagtggttcatgaaggcgtctgcgtcagacaggactcctccgggaactggatcaaaatttatccggacagtcgtctgaatatcggggaaaagaacgaatctaaaggagcggcgctcgaacattatccttatccgttcgcccagtccggcagctccgtggaaaaaacggcaatcgtcattccggaccatccaagttcggctgaaatcgaagcggcagttaaaacagaagcatacctcaaaacggttgacaacagcatcagcacgaagatcttgggtgaatctgacctggcgaagatcgacaggccgacgattgtgatcggcgttcaccatcactggagcggcaaagtgaaaaagctgttgaaacaagcgaaactcgaagcaaaagaagacaagcttttgcttgcgaaacggatgctcaaagcaaaggataagcagcagcctgtattgtttgcggccgcagcatctgatgatgtgctttctgaaaaaatcagcgtcatcaccgacaaaacgtatgccgcccagctcagcggcgacacgctggcaatcggcaaacttcagcagcatagcaaacggggcggcagcaagctgacacttgaggatttcggggcgggggatttgacaatcggttcgggacagacatcttccgagcatttttattatcccgcgccagctctattagacaagaatcagcctgcaaagctttcgcttgcgatgaaaaaatcgaaaacgattcaaaagcaggccggccaaagcgacttagctgcggaacaggcggagctgaaggtcatgatcaatggccagcctcattccgtcggacttgacgatataggaaaagaagacaaaaacggcttttaccatgtttctttaaaagtcgatccgaaacttttgcaaaaaagccgttacattgatattcaatttgccgcttcaggcttgaaagagaacaacccttgctacgcggtgaacgaggacaaatggatttttatcgataaacaaagtgcattgtcttaccatgtcagcgacacgtcagcttcagcagattttcaagcgtggccgcttccctacgcgggtgatcataacaataaaacgctgatgatcctgcccgacaatgcggatcagtcgaagattgatgagctttcgcttgtagtcggctccttcggcagcgaagcccggcaggcattcacagtaaaaacatcctcggaagtcaaaccggatgacgtgaaaggaagaaacgtaatcttcatcggaagcgtcgatcaattctctctgctgaaggaaaaaacagccgaattggctgttccgacggcgaaaaacggaacatttgatgtgtcatcttttcaaatgctgaatgaaacgacaaaacaagtcgcgtttactcaaacgtcgctgtgggattcaaattactcgatggctgttttcgcgccgtttaaagggcaaggcacagcagtcacaaaagaaatgatcaactttttgaacagcaatgatttcgcagcaaccgttgtgaatgaaacggacagccatcagctatttacaaaccatcaacagctgacagcaaaatccgccgaaaccaagacggatgataaacaggaaagcaatcagcagcatgtgctgtacattgccatcctgatcgtaatcatagcggcagcggttattttgatcttgacaacggcaaggcgcagaaaaagaaaggccaatgccggcggagggattgacgaataaaacaggggcttgcttttagcccctgtttttttataagtattcaacctgtttctcatatacacccttcgcaattttagctaaaacatcgattccccttataatatcttcatccgccgcggttaggctgattcgtatacactggtgtgaatgcgccaggcgccgggattgacggtgaaagaaagatgatccgggaacgataatgactccatccgctttcatatactcatacagcgctgcatcggtcaccggcaggtcttcaaaccacagccatccgaaaagcgatccttccccttgatgcagataccatttgatgtcttcaggcatcttgcataaaagcgtttccttgagcagcatgaatttattgcggtaatatggcctgacttcattcagcgacacgtcggcgaggcgcccgtcattcaatactgatgcagccatatactgccccagccttgaagaatggatcgccgcattcgactgaaaagcttccattgcctgaatataccgggacggcccgatggcgattccgatcctttcgccaggcaggccggcttttgaaaggctcatacagtgaatgatctgctcgttgaaaatcggttccatgtcgataaagtgaatcgccggaaaaggcggagcatatgcggaatcaatgaacagcggaacattcgcttctcggcatgcgtctgaaatgaatgctacatcttctttaggcaagatgtttccgcaaggattgttcgggcgcgatagcaagacagcaccgatgcacggatcggtccgcatcctctctaaaaaccccttacggtcgagctcatatcgaaacgtatgatcatccaatttcgatatgagcggagggatcccctcaatcatctcccgctccagtgccgccccgctgtatcccgaatagtcaggcagcatcgggatcaaggcttttttcatcacagatccgcttcccattccgcaaaacgaattgatcgccagaaaaaacagctgctggcttccggctgtaatcaacacgttctcttttcgaatgccggcgctataccgctctgaaaagaagcggacaacacttgcaatcagttcatcggttccatagctcgatccgtattggccgatcaccgaagaaaacctgtcatcgtcaaggagatcggcaagagccgacttccacatggctgacacgccgggcaaaatcatcggattgcccgcacttaaattaatgtatgaccgttcaccgccggccaggacttcctgaatatcgctcatcacagccctgacccctgttttctcaatcattttctctccgattttgcttaatggcggcttcacgcttccagtctctcccgttcaaatcgaagacgggcggtttcgattttcttattgatctcgtcaatgaaatactgttccgggacgctgaatcgctcgccttcccgtcccggaggcaggtattgtctgacatagcgctccgcggcctctttgtatgccgtgtcatcctcgatttcttccagctgttcaatttcggccacaagctttcttaaatcgtccatgcagcgtggaaggtcaagcgacacgcgcttctcttctcctttttgaatggaacggccgttttcaatcatccagctgaacagaaaatagcctgtcccggaatcaaaattccgcgttgcattatgctggctcggatagcgcagcagccgctcatacaaaacaaattcgataatttcctcccagccgtcatattgccgctcccacaaggtcaggattgcttggcaatcgaccttgacttcttctaaaatgcctgcgaaaaaattcattttcgcctgaatatggagatgaaaaggtttttttccgcaatgatgaaaatagtcgtgaaggtagccccacaacacccttgcttcatatgtgcggtcgggggaaagctgagccgacttgaaaggcgcatgttcaaaaatggccctcgctcttttgagcgtgtcctcatggtaaatgtgataaaacttattaaagtagaaaatcgcgaatgtctgtgatgtgattttctcttttgttttcacattttcagggaagaatacgatgcatttttcttccgtgaacccctttgttccggcgagcagcttaagggattggcagccgttttcaggatgaggcagatcctcttctatcggcctcatcatggcaggttcttcacgaacggctaaaaaggcttcaaaatagcagcctttcgcatgaggcccattcggcgtcacgatcggcgccgcaaaaaaggtcgtctcctgatcatgcggagcccggtaagccgtcaataaccggtcaaaatacggcgtctcccctaatccgcggctgatccaatccaaaacgtcctctttaaacgcctcttttgcagccgttaagtgaaccgcttcataaatggctcctgcgtcttcaatcaattgcagcagaagctgttccgccctttcgtgatgctctgtaatctgtcctttatcattttggtacgtctgcaattcatgtatgttcggtacaatctgctcgttgaccatgtttacaatgtcccctgtcaaagtcgtcatcggcttcctccttcgattgatttaagcccgtggattgtaaagcacatcggtacttccccaaaatctttaatgactttcaaacggtgttcatcggctgctttaatcgtcgtgatgcagccgtcagccgcgtttgaagcgcaggccagggccgcttgagcattgctggtgacaaattggacttgactgctgaacagctttgccagatgagccggagcagggtgtgaagcgacgatttgaatatccgatgccatcgtgtgctgttttgcggcaaacaccatgttgtatgtaggcatcacaaaactgtctataatctttaagtccgctagattctcaaatacgatttgatgcaaaaacgggtaaacggcgcagcctaagaggactgaattttctgtcgatttaacatggagcagcgcttcttccaacgtttcataaagcctgacttccccgcggacccctttatttttgagccatagcaggccggctttttcacagttcgtgcctttgggaccgagcgtatggacaatcatcacggcttgctctttgtgcactttagtcgagatcatcttaacctcctattgtacccgtcaaattattttgataaatgatatgaagctcatcatccagctcccggtagaaagcttcacattcttcataagaatgatggcttgttaatataaaccccggataaccggaaaagtgcgggtacgggaggatctttgcgcctcttctcataaattgaaacacccgcttaacctcctgcctctgtttgacttcttccagtccgtcgattttttcaaaagtgccggagccctgtacaggaatgatataattgccggctgtccttacaggcctgatctcgccttcaaactcgctgctctccagcggctttaatgcattttgcaagacaagctgcataaagttgatgcctgtgctctctttgacgatgtaatgggaaacccctgaaccgccgattctggcgcccacctcgataacataaggtgttccatccttgtccagcctcagctctgtatgagccggcccctggtgaatgcccagcgctgaaacggcgcccgtcacttccttgacgatcgcaaggcgcgtctcttctttcaattgagccggagcaatatagaccccttcttcaaaaaacggccctttgctgttccctttgtatccaatcgaaagaacatgtacgtttccttgaatcgacagcgtttcaatcgcgaattccggcccatcgataaattgctcggctacgatgcccgttttgccgtgcacgaatcgattgaggtccctttggttgacggcctcgactttccggacggcctcctcaagctccttccgatcatcaacacggacgacgccctggcttgagaagccgttgaccggcttgacgactaatggatacgacagtttcctgttttccaggtcagcgagcgtatggaactcgtgaaaaaccggcgtattcaatccgttttgctgaagtatgctgcgggttttatttttattgcggcagttttccattgttgtgaaaggaagccccggcagattcaaagcttcagcagcttttgccgtgaaaggcaaagccggttcaaacagtgtcatcacgccgtcaaacggaaattcgacaaatgtctgcctgacgacatccatcgccgcttcttcatcttcaaacaacggcagcggcacacagcgttccacagccggaagattgcccgggaaatcttcggccgaattgtaaaagaacgtgaccttcaatcctaaacgctcagcttcttcaaaaataaatggcaggtgcttattttgacaaatgatggccaagtttttgtttcgtttcgtcaattttcgcgatcctctcttctttttttaagttgatgaacatcacaccgaatatgacaaacagcgttcctaaataaatattcgcattcagtttttcatccagaaacagaaatccgatatagagcgcaatgacaggggagatgaacaagtgggaagtcgcttttgagatgtgccattttttaagcagataaatgttgatccaaaaacccaaaatcgagccgacaaccgctaaataaagcagcgcataaagactcacaccggaaaacgttcttgtcccgctttcaaagatgaggctgctgatgagcaataccgctccgccgctcagcattgaaagggagttaaagcttaagatcggaagcgaacgaattctctgctgtactttgatttgaataaaagccgagccaaacatcgcacacaaaatcacaatcattgcgacaatttcaataacatcgactttgatcagcagttggttgccaaacacgattgtaatgccgagcaaagccaggcatatcccccatttctgcagtttcgtcgccggtgtccctttgacgaggcggttgatcatcagggcaaagactgaaatgcttgccgctaatatagacaccaacccgctcggcaaataaagagaggcccaataaacagatccgaatggaacggaaaaatacatgatgccgttcaaaaacgacagcactagcagttcctttgacagaacaaactgcctccgtgccaacagaaacgccgcgatcaaaatgcttgcgatcatgaaccgcatgccggcggaccaaaatggaaggctgtcactcagcccggctttttgaaaagcccatgtcgtcccgccgatcaaacataacacgataaataaaatatgaacccgatactttaaaacgtttgtcagcatatagcattcacctgatttagttattgtcttgctgtcatttattttcagaaaataaaatcttttctgatcaaaatggattatgagggaaattataactattatatcaattacagtcaatcatacttttgaacctttagaatatctttacaaatactgcgaacaaaaaaacactcacttcgattaagtgagtggaggcgatattggtttagcttatatttctatcttttgggtgcataccgcttttccggatgacccgaattctctcatcttatgtttaaccgtttctttgactgcgctgatccctggcgtcatataggcgcggggttcatataaatcgggattgtctttaaatatgctgcgcgttttctcagtccaggccaccatgcattcggtattaatgttgattttcgcatggcccagacggatcgttcttgcgatttgatcagccgggatgcccgaagctccatggagaacgagcggaatgtccgttacccgtgagatttcttccatttccttaaatcccaaattaggctcgccttgatattttccatgaacggagccgagcgcggctgccaaagcatcgataccggtttctttgacaatccgctcgcattcaccgatgtcggcatactgcactccgccgataagcccgtcttccatgccccctacggtgccaacctctgcttcaaccgaaacattgcggaccccggcatatgacacgacctcttttgtcatggcgatattttcatcgattggtgaatgcgagccgtcgatcatgactgagctaaaacccgcgtctatcgcttgcttgcagcgctccggacttttgccatggtcaaggtgaagcacgacgggaacggagatcgacatttcctcaatcaaagccgcaaccattgcggaaaccgttttaaatccgcccaaataatcgatgagccgatctgaagcggctgcgatgacaggtgaccgttcttcttccgctgcctctagaatcgcttttgtccattgaaggccattaatattaaattgaccgattgcataatgatgttcctttgcttcttgaagaagttctttcatggaaacgaaagccacgttcacccctcctatcccgtattaaatcttgaagtattttgaaacaacttcaactgttgtttctttggccgttcgaatcgtttcttccgcgctcagcttatagtattcaggtctgaacaattcaactgatacgacatccgaaaaaccgatgtctttcaaagttgataagtgggcatccaagtcgatggctccctgtcccggccaaacacggtcttcatctcttaaaaatccgattggaaagtcttccgtgtcatcgatatgataaatgaagattttcttgccgtccgccttttttaaatcctcaagacttgagcccattgcatggaaatggaagctgtcaaaaacaaggccgacattatcgcggttcacggtcatgacgatgtcataggcctggctgaacgtattgaccgtacactccgggtgaccgacaaactcgacagcgatctttacgccgtacggctcagcgatgtctgacagctctgtcagcacttcgacggagcttgctttaatatcttcttttaagattttttgttcggtgacaagcggtaccgcgaccacgtatttcacaccaagcattttgcacgtttccatcatgcctttaaattcttcgatgatttcacggtgccctttttcatcgcggttgttgaaaaagacaagggcattcaaggccagcggcttaatatgatgagtttgaaaatactcggctaactctgagagagcatggtcttttaagtactcaggcagcttatccatcgtccggatttcgatataatcgtatccgtgcttctcacagtattcgaggtcttttgcaaggtttgaattttccaacgtcgttgcttcattaaagcatagcttcatattcgattctccttctctcatatccttgtgaagagaagttcggcagggcgccgaactcaggggggggcttagcctaataattcttgtttcaatttttcaagcatgaatctgcttgattcatccgctctttcatcgacccaagcaaaaacggcgttcgtcgcaattccgtcgaacttcatctctctcagctttctgaagatcatatcaaaatcgacctcgccttgaccaatgtccaaatgctggtgaaccgttacttttgcgtcaggcggattgacgatgtagcgaaggccatgagccgctttatgattatacgtatctgcgaataaaacatgtgtgaggcggtcgccggcttcgtcaaacattgtctcgatgtcgcctttgccgtcatcataaaagaatgtatgcgcagtcgagtagacaagattaatccaatccttgtcaagcgcgcggatcatatccaacgcacctttgtgcgtttcgataaaatcgtatggatgggcttgaagattgagtttaatgccttctttttcaaagattggcagaagctcatccatggatttgataaatttttcttcacttgttaaaggatcgtattttgaaccgctgaattcactgttcatcaaatcgacttcaagctcgaccgcaatttcgattgcccttttccaattgcgcacggcggcctgacggcgatcttcatcaggacctgcccagtggtaaagcggaaggagcgatgaaagcttaacaccggtatctcttaaaagccgctttaattgtttgattttagctgaatcgactttcggatatttatagaatggacaaaaatcttcgcgcggcgatagttcgatatattcgtagccaagctccgccgttttatagaccgtttcttccaaagtcaaatcatcacgatacatcgatggatccaatgctaatttcatacttttcactcctcggaatgtttttattttttaacagttgtgaacgtttgatagaattccggcttctcctgaagcgccacaggttctttctgtccggattcctgagctttcacacaggcgtccgtcgtcacggcggcgatatagccgtcccacgcagtcggcccgctgacctcgcctttctgttggatcgagtcaatgaaatcttgaatttctacatcgtaagcgtctacaaagcggcgctgccaatccatgaggatatccgtcgagaatttgccgtcttttctgagagagatgcttgatggttcaggaagcttcacgattccgtcctcgccgacgatttcacactggatatcgtagccgtatttgcagttgacatagatttccgcattgatcacgactccgccttttgtttcgatgatgacgatttgcggatcacgcaaatgaggaagcgcgtttttcgattttttcggataaatgacctgaacggattcgtagtcatcattaatcagccagtgcagggcgtctatttcatggacaagcgtatcgacgacagccatatctgttgtatagttgtcgcctacaaccgggttgcggtgcgcacagtggatcatgaggggctcgccgatgacccgattgtcgatcgcttctttcagctgtacgtaaccgctgtcatagcggcgcataaagccgacttgaacgagacgtttgcccgctttgacttcttcattgacgatccgcatgcatccttccgcagtcgtcgccagaggcttttcgcaaaatacgaatttgtttgctttaatcgctttcaaaacgcttgattcatgtgccggtccccagcttgttactaagactgcgtctacattttcggctgcgattagactgtcgtcatccggatagaccttggcgttcaggctgtagtccgttacaacttgctgagctgcctcctggttcacatcggtgaccgcgacaatttcgccgccggctaatttatttgtgatgcggttgatgtgttcttttccgattgctcctgtaccaataacaccaatgcgtagtttcattgatagccactccttcaaatgtagttacataatttttcttgtttgcacttgcccagcttgagccggaggagtcccatacagctcttcctgaatttgttcaagcgacttaccggatgtattcggtgcaaaaaagagcccgatgagcatgctggccgttacacatccaaggagaatggccgccataaatgcaattccaaaattcgagatgatcattggaacgaaaaggctccaagccccgattgagatacgaacaaggaagaacatcaatccttgtgcagatgcgcgatattccgtcgggaaaatttcactcgcccataattgatagttggcctgttgccccgccccgttgtttatgccgatcatcacgataaagaggatgagaatcggcatgccctctgccggaagcagaaacaatgaccagccgatcaccgccgcaaatgcggagatcccaaacactgtcttcctgtatttgtctgcaaacggcatgaagataaaagcgacgccaagcccggtgaaaataaacagccccatctgcaaaatatttgccatggtcgctgatacatcgccgacctgctgataaatgtaaggcataaaaaaccccatgacacctgcagccagattccaaaccaagtacacgcccattaagaataaaatgcttttcaaatacttaggctgaagcaaatcgagataaggcgtcttcggcttcctgacggcttgagccatttcggattgatcctgccaggcatcggattccggcagccttttccgcagaacataagtaatcagtgcgataacgagcaaatgcccaaacacgattttattgcccaataagcctaaatcaccgagcaggaccgacagcagcagaaccacaaccgctcccgcagcccatgcgacctgtgcaaccccgcaatgacgcgccctgtttttcttaggtgcgttctctgcgatgatcgtccaggaagccgtaatatcagctcctaccgataaaccgataataatgtaaccgcttaacaaaaaggggaagctggtgccgaataaaactaaacaaatgcccagtgcataaaccagcatactgttcgtatagacagcctttcggccaattttgtcggccaaaaagcctccgagcagcgctccgattgctgccgaaatggcgttggcgctaaatgcgccgagcagtccgatctgtgtatcagaaagcttcaggtaactgacccataaagataatcctgccgatcctgcgacaatggagcctgcatcaatgtaatttgccaaagctgctgcgacggttcgtttattgaatggtgagactgctgcacttccattgctcaatttagagcccccttaattggttgctgggacattcaacaagtgacgatcgatgtactttctggcgatcaatgcgtattcaagcgggttggcaacatcgggatcctgctcggcttccactacgatccagccggaatagccgtgctttaaaagcgtttgatatacttctctaaaatcgatgcagccgtcgcctggaactgtgaacatcccttgcagaaacgcctgttggaacgaatttccttcccgcttgcatttctccatgatcttaaggcgcgcgtctttaaaatgaacgtgcctaatacggtcaatatgcttctctaaaatgttcatataatttccatctgaaatgtaggcatgccccgtatcgtacagaaggtgcacaagtgccgggtcagttcccgccatgagccggtccacctcttcctctgtctgcacgcctgtgccgaggtggtgatggtagacaagcttcagtccgtaacggccggcgatttccccgaggtgatttaaaccttcaaatagccgctgccattcttcatcggtgaaataaggcttttctttaaacacgtttttatccaagccctgcacactgtacgtctgttctgatacgaccgcaacatcggcatggacgtcttttaagtactggcagtgagccgcaaattccttggctgcttcttcaatgccgtcccgaatgatatagctgctgaaccacttgccggcaatccttagattcctcagctcgagctctttattgagaatggccggttccggaaaaaagccgcccacttccgtgccttgaaagcccgcaacaacaatgtcgctcaacaaatgctgaagtgtgtttcccgcgccgatttccggaatatcatcgttccgccatcctatgggggcgatgccccatagaatttgtgtcttgcccatcctggtgcctcctttaatactgctttgcagattccagcattttttcttttgctttatacgccttttgcacgctttcctgttcggaaacctctgcaacacctacgtgccaccagctgtcatagccgtccgtcatcgttttcggcagcaccttcatttcaatcaatgttgagacatcttgttttttggcatcttccagcgccgcttttaattcttcaatcgtgttcgctttgtaggttttcgctccatagccttcggccactttcgcataatcgacattgagaatctgattgtctgctgttctgaattcacagtagtagctgccgtttccatggtccatttgcagattgttgatgcagccgaatcctgagttgtcaaagagcagcacgttaatttttttattatattggattgctgtaatgagctctgagtggagcatcaggaagcttccgtctccgaccagtgaataaacttctctatcaggatgcgccaatttcaagccgagcgttcccgatacttcatatcccatgcaggaatagccgtattccaggtggtacgtattcggtacgtttgaatgccacagccgctgcagatctcccggcaaagagcctgctgaacaaatgacgacgctgtccggatcaactgtttcattgatggcgagcaatgccgttgtttgcggcagttcggtttgcagcacatccgcatattcgttgagtatgtcttgagaaaagtgatctttaatttcaggagtgaagttttcgcgcttaaatgttaccttgcttaagcggtcgcgttcagcaagccattcgtctttcagctccttgatggttgaaccgaactcgctcttatagccttccaataagccgtgcagtttgccgagcgttacttttgcatcggcaacgacttggaaagcatccagtttataagcctgcattctgctgacattaatgtttaaaaattttgcgttgtcaaagtcaaaagcggtttttgatgatgtcgcaaaatcggtatagcgcgtgccaattccgatgatcaggtctgccccgcgagccgctttgtttgccgccagcgtaccggtgattcccattccgcccaaattgttggcaaaatcggcttctactgtggatttaccggcctgggtttctaccagcggaatattgtaagcttcagacatggcgatcaattcgtcgcgcgcgccggaatatttcgctccgccgccgaccaagatgagcggttttttgctcgacttgatcagttctgccgctcccttcagttcacgctcgctcggctctttgcgatcaacatagtgaacgcgtttttcaaaaaagctttcatcgaaatcataggcctcgccttcaacatcttgagaaatgcaaatcgttgcaggaccagcttttgcagggtctgtcattacttcaaaagcgcgaatcagactgctcatcaactgttcagggcgcgtaatacggtcccaatacctcgaaacaggcttcaatgcatcgttcgtcgtaatcgccgcactgtattcctgctctacttgctgaagaacaggatcaggctgtctcgtggcaaatgtatcggctggaatcaagaggactggaatgttgttcgcaagcgcagtacctgcggctgccacaaggttagctgctcccggtccgactgatgtcgacacggcatagatcttccttctcagcatttgcttgctgtaagccattgctgcatgcgccattccctgctcatttttgccttgaaacacctttaagtggccggcatcctgttcaagcgcctggccgattccaacgacgttcccatggccaaaaatcgtaaagattccctcgacaaacggagtttcttctccatctacatggatgtactgctgatttaagaacttaattaacgcttgtgctgtggttaaacgtattttcttgcccacaaacgatcccacctttattcatattcttcatttaagactgagccgcaataagctcttcaatctcggcgactgtcggcatcgcttcagatgagctgtgctttgaaacaacaatcgaggcggaagcgcttccgtatttcagcgcggtttcaatatctttgcctgaaacgagtccgtagaggaaggcggaggcgtatgaatcgcccgctccaaacgttttcaagaccttcgttttgtacgctttcgcccggaagacgtccccggatttgctgtatgcatatgaaccttcgacaccgtgcttgataacgacaagatctgcggaatgtgcaaataaatgctgaacagattcttcattgctgccgccgctcttattttccattacatcaaactcatcacgcgtcccgatgacaatgtctgattgttcggcaacaagcgtatagtagacggccgtttcctccgcagatgtccacgtatatggacgatagtcaagctcaaagaccactttcacttgatgctttttcgccagctgtacggctttcagcaccgcttcgcgggaagggcttttagccagcgccgtacctgacacaagaagcatcttcgatttggcaatatagtcttcgttcacttcagaaggggcaaggtaaagatctgcaacatcatccctgtacattaaaatgctgcattcttcagggcttaaaatttctgtgaaagcaagcccagctttatgtccgtctttatcaaccgccatttgtgacgtatcgacacctgtatttctcatataggtttcgatgaatctgccgtgctggtcatccggaatcttcccgataaatccggtcttcaagcctaatttggaactgccgattgcaatattagccggggagccgccgacatattttgaaaatgtcatcgtctgctccatcggcctgttgtattcgactgcgtttaaatcgatgcatgcgcggccgatcgctacaatgtcaaattctttctcttcattaaacgtatacttcatcttcaacagcctctccttgccttattgttagcgttccaaaatccattcatggtcagggtcgttatgaaacttccatttacgcgtcggccctgccatcacgtttaaataataggatgtgtatccgtcaggcaccccgacaggatggtatccggccggcacgatgacaacgtttccattttcaacagtcatcgtctcgtcgatggaacggtcatccgtgtatacgcgctgaaatacgaagccttgctgcggatcaagttcatggtagtatgtttcttctaaaaaggactcttcaggcaggttgtcttggtcatgcttgtgcggcggatagctggaccagtttccgctttcagtgtagacttcgacgactaaaagactgttcgctgaaggatctgaatccggaagtatgttatggacggttcgtttattgctgaattttccccggttctcaataccgttgtcttcagctttgatcagtttcgtcggaagctggttttcagaaggtgaatagcacagggcaactcttgcctctgtaacggcggtaatgccgaacttgcggtcatttgacacatatacgctgtcggtcggctttctttcgaaaacgctttctctcgtgccgatattttcaaatgtctgttcatgatcggttgcggtaatctttccggtaagcgcgacgatgcagcattcttgtttgctcagcgattcttcatagctggatcccggtgcaagatcaaggactttaaactcgacataacttagatcggaattcgattttttcacttcgtgtacaagcttcacgccttgtgacagctcattcgcctgcggcttgcgcaacaaatgactcatggataaagcctccttttcaaacttgaaacatgatccgaacagtgcgggaaccgcaccgcccggttttttcacaattaattgaagtcaggcgccggatatcttgcagtgacgacctttttgcgcgtatagaaatcgacgctgtcttttccgttggcatgcaatgtaccaaagaacgaagacttccatccggagaacgggaagaatgccatcggagccggtacacccaggttgatgccgagcattcccgcatcaatgttttcacggaaatagcggatcgcattcgaattcgatgtgaacaagcatgcgccgtttgcaaattcggactggttggcgatctcaaccgcttctttcaagttcttcacacggatgaccgatagtacaggagcaaaaatttcgtccttccagatcgtcatatcagttgtgacattgtcaaagattgtcgggccgacgaaatagccttcatctgtaacattttcgcgtccgtcgcagacaagtctcgcaccctcttcaattcctttttgtatatagccgagtgtgcgtttcttgttgtcttcgcgaatgacaggcccgaggaatacaccgtcgtcaagtccgtttccgattttgacttcagatgctttctgaaccaatttttccatgaactcatctgcaattccttcttcaaccgttactactgcgcatgccatgcagcgttcgccggcagatccgaaagcagcgccgataatatttgttaccgtatcttcaaggttggcatcgttcagaacgatggtgtggtttttagcgcctgtcagcgattgaacgcgtttcagattttcgcttccttttttatagacatattctccgaccggttttgaaccgacgaatgaaatcgctttaatttccgggtgttcgagaatgccgtttactacatcatgtgcgccgtataccacattgaagaccccttttggaagtccggctttttcaaacagttcaactagcttttccgtcaaaagcggcgtccgttcggaaggcttcagaataaatgtgtttcctaacgcaatggccattgggaacatccagcatggtaccatcatcgggaagttaaatggtgcaattccgccgacgactccgatcgggtaccggtagttcgccgcttcaacatcggttgcaattgtagcaagtgaatctcccatcatcagtgaaggcgctccagctgcaaactcgacattctcgatgccgcgtccaacttcacccaacgcttctttcgtgttttttccgttttcaatcgtgatgaggtgggcaagctcctctttatgctgagttaaaagctgctgaaagttaaatagaattcttgcccggcgcggaacagccacttttgaccatgttttaaacgcttcagccgctgtttgcgctgcgtattctatatcctctcgcgtcgaaatcggcacttggcacagcacttctttcgtcgctggattgactacatcttcatatttgtcggttttgctttcaacccattctccattaatatagtttcttaactttctgatttctgccattcttataacctccttgaatattaaacatctcctggtacagatggggcaggtttcaaccattatgtatgaatgccgaacagctcttcattgcacaacggattttcgcaaaaaacaggaattaaacgcttacaaaagaaattaatgaatagaactatgattttatccaaagaaccatgacgcaataaaacgtttacacatcagaaatttctcaacattatcatgttttggtcacttcttggttatattttaatccggccttacccataagtcaatcaaaatcattaaatttttcttttgtaagatttgtagaaaacgttaaaatgatttagggaaacattgtataataaaaagaaacagggcaaatcttgcaaaaaataatcaccaatggtatcattttttaagcaattattggttaacttttgggttcgtcatatatatttagtcaaatatactagaaggagatacttagtatgaagttaatgcggattaaagaaatggaagattatattttgaccaatggcaccgtttcgcttgatgaactatgccaggtctttaatgtttcaaaaaacacggtcagacgcgacattaacaagctgaccgagaaaggagttataaaaaaagtctacggcggcgtaacagcgatcgaaaaaacggccttgatcccttttgaaaacagaaccattcaaaacaaggatgccaagacaaaaatcgcgcgctatgcttcacgctttattgaagaccatgacctgatttttattgattccggcacaacgacccgatccatattggaaactcttgatccaaataaaaatgtaaccgttttaacgaacagcctcgacattatcaacgctgctgcagcgatgcaaaatataaacttgatcatcatcggcagcaactacaaacggaaaacgcagtccttcgtcggcatggatgatccgggaacgctggataaatataatattaataaagctttcatgtcggcaaccggcgcaacacttacccatggactgacaaactccgatctgcttgaatatgaaattaaaaagaaaatatccgaaaaagcaaaacaagtatatttgctggccgaccattccaaattcgggaagtcgaccctgctgacgtacgcgccgtttgacagattgcacgcgatcgtcacatctcaggcgcttgatgaggaatatcacgtgtactgtaaagatcgcaaaattgaaatccatttggcaaaacatgtatagttgaagcggacacccttgaccggctgtttccaagcggccggccaagtttatttatctacacatcatatcaggaggggaattcaatgaaaaaagttaaagttggcaaatcagacttgcacgtatttccgattggtttgggaaccaatgctgtcggaggacataacctttatccgaatctcaatgaagaaacgggaaaagaattggtgcgggaagcaataagaaacggcgtcacttttttagataccgcctacatatacggcatcggccgttccgaggaattaatcggcgaagtccttaaagaattcaaccgcgaagatgtcgtgattgcaacaaaagccgcccataagaaagaaggagacgattttgtctttgacaactctcccgcatttttgaaaaagtccgtcgaagaaagcctgaagcggctgcaaactgactacatcgaccttttctatatccattttcctgatgaaaatacgccgaaagacgaagcggttcaggcgctccatgaactgaagcaggaaggcaaaatcagagcaatcggtgtatccaacttttctcttgagcagctgaaagaagcgaacaaagacggattggtggatgtgctccaaggcgaatacaacctgctgaacagggaagctgagacgacattcttcccgtatacacaggagcataacatctcatttgttccttacttcccgctcgtctccggattgctcgccggaaaatacagcgaagatacaacgttcccggaaggcgacctgagaagagaaatggaaaacttccaaggcgaacgcttcaaagaaaacattagaaaagtgaaccagcttgcgccgatcgcggaaaaacataatgtcgacatcgcccatatcgtcttggcctggtacttggcgcggcctgaaatcgacgtgttgatcccgggcgccaaacgcgctgatcagctgatcgacaacctcaaaacggcagaagtcaatctgtctcaagaggacattgatttcatcgaccggctgtttgcccgctaaatgatcaggaaacctatcttaaaagataggtttctttatttttaaaatcctgttgacagcgcttccatttttgatatgataggaaagaagttaatacaagtgacggagaatgggagattcacaataagaccctcttgtgccaggggtttttttgtggatctctttttcttcgtcatctaagagggggcgaaagcaatcgtaatgaatagacggcacctttattctgtataacagcttgaaaggagagatcatgttatgaaaagactagtccgcagcatcttccttataacggccgcaatcgctgcttttggttttggattcagcgggcatgcggaggcggcaagccattcccagccgcagctcaatccgaacaagctactaaatgtcgcgcaccgcggcgcatcggggcatgctcccgagcacacgcttttggcttataagcttggacaaaaaatgaaaggcgattacatagaaatcgatcttcaaatgacaaaagacggccacttggtcgccatgcacgatgagacattggatcgtacgactaatggtacgggttttgtcaaagactatacgctgaaagaaatcaaagagcttgatgcaggctcctggtttaacgaagcatatcctgagcgggcaaaaccggagtacgccgggctgaaagtgcccacccttgaagaaatcatccaaacattcgggagaagcgcgcgctactatatcgaaacaaaatcaccggaagactatgatcatatggaagaaaagctcctggacatcctgaagcaatacaaattgaccggagcagacattcattcaagcaaagtcatcattcaatcttttagtcctgaaagcttaaaaatcattcataacgctaatccaaacattccgctagtgcaattattatggtacgacaaacctgctgccattactgacgccgaattaaaacaatatcaatcttacagcgtcggactcggcatgaactttgaccgcattggccgggcatacgtgcaaaagattcgacgcaccggcatgctggtccatccttatactgtgaataaaaaagaagatatgaagcggctgctcgattggggagcgaccggaatgttcaccaactttccggaccggctgcgcgatgttttgcgcgaaaagaagtaaatgaataaagaaggggaataccatgttaaaactgtttaagccagcaccgccgattgagcggctgccggaagatcaaattgattcggaatataagaaattcagactgcaagtttttctcggcatcttcatcggttatgcggcatactatttaattcgcaaaaatttctcgcttgccatgccttatttgatcgaagagggcttttcaaagtcggcgctcggctttgccttgtccgctctatccatctcttacgggctgagcaagttcgtgatggccacgatatcggaccggagcaatccgaggatgttcctgcccgccggtttgatcctttccgctgtcatcagcctcttgatggggtttgttccttttttcacctcatcgatcgccattatgtttatcatgctgttcttaaacggctggttccagggcatgggatggccgccgtcagggcgtgtccttgtccactggttcagcgtcagcgaaaggggaaataaaaccgccatatggaatgtcgcccacaatgtcggcgggggactgatggcgccgattgccgttgccggcgtcgccatcttctcaggcataacgggatctgctacaggctatgaaggtgtgtttattttgccggccttggtcgccatcgccgttgccgtcatttcttactggctgatccgggatacgccgcagtctgtcggacttcctccaatcgaggaataccgcaacgattattcaagcaaatcgaagaaaacctttgaaaaggaattatcaacgaaagaaatccttttcaaacatgtattaaataataaatgggtgtgggcgatcgcacttgccaacattttcgtgtacttcgtccgctacggcgttctggattgggctccaacctatttaagcgaagaaaaaggctttgacatgagcaaatcaagcgtcgcttattttctgtatgaatgggcggggattccggggacattgctgtgcggctggatctctgacaaatggtttaaaggacgccgcggaccggcaggctttgtctttatggcaggtgttttgatcgcggtgcttgtgtactggttcaacccagccggcaatccgatgatcgacatggcatcattgatcgcgatcggattcctcatttacggtcccgtcatgctgatcggccttcaagcgcttgactttgttcctaaaaaagcggccggcacggctgcaggattgaccggtctgttcggttacctgggcggaaccttgacggcgaatgcgctgatgggtgttatcgtcgatgcatccggctggaatgcgggctttacgcttttaaccgcttcatgtgcaatcgcagcactcatatttgcgatgacttggaatgtgcggggacaggaagttgtgaagcattaacatcaaaaaaagatacatctcgcaagaagctgagatgtatctttttttatttttatgccattactttgcatatatcgttcgtaaattcgacggggtcttcaattggcaagccttctatcagcagcgcctggttgtacaggaggccggtgtacagtttgaatttatccttgtcgttgtcaaaagcattctgcaatgttttgaagacttcgtggtttgtattgatttccaatactttatcagcctttacatgctgattgtcaggcattgcgtttaagattttctccatctcgatggtgacttctccgtcagcggcaaggcatacggagtgagtcttcagccgttttgacgccctcacgcttttcacttttccatccagagtctttttcatctcttcaaacaggtctttgtattggctgtcatccccgtcagattggttttgctcgtcatcgttttcgattccgaggtcgccgcttgataccgacttgaattctttctcttgataattcgccagcattttgatggcgaactcatcgatatcctcggtgaaataaaggatttcataccctttttccgaaaccagctcggtttgaggaagcttttctattcggtcatacgagtcgcctgatgcataataaatgtatttttgatcttcaggcattctggacacatattcctcaagggtgaccagctttttctcttttgatgaatagaaaagcagcaggtctttcaacagatctttatgggctccaaaatcattgtataccccgaatttaagctgtctgccaaacgattgataaaaagactcgtatttttctctgtcatttttcagcaagctcttcagctcattcttgatttttttgctgatgtttttggcaatcagcttcagctgcctgtcatgctggagcatctccctcgaaatgttgagcgataaatcttctgaatcaaccattcctttgacaaagctgaaatggtcaggcagcagatccggacacttttccatgatcagcacaccgttcgaatacagttccagacccttctcgaattccttcgtgtagtagttgaacggaatattttcaggaatgaataaaatcgcatggtatctcaccgcgccgtctacgcttgtatggatgtgcgcgagaggcttgtcaaaaccgtaatgcttttccttataaaacgcctcataatcttcatctttcagttcgcttttgttttttctccaaatcggcaccatgctgttgaccgtctgttcttcctggacttcttcaaattcattttcggcgccttctttcggcttgttgaccgcgacatccatcttgatcgggtagcggatgaaatcagagtatgttttgatgatcgcttttaagcgatgaacatccaggtattcatcatagttttcatcgtctgtattctctttcagcttcagaatgacatcggttccggctgattctttcgcagccggttcgattgtatagccgtcggctccggctgattcccattgatgcgcttcatcgctgccatgggcttttgtaatgacggtgacggtgtccgcaaccataaaagcggcgtagaaaccgacgccgaactggccgataatatcgtgcccgtcttttaattcgttttcttgtttaaacgcaagcgagccgctcttggcaatcgttccaagatgctcttcaagctcttctttcgtcatgccgattccggtgtccgcaatggtcagcgttctgttttctttatctgcggagatttttatgtagtaatcgtctttgttaaatgtcagtgaatcatctgtcagcgctttgtagtagattttatcgatggcatcgctcgcattggatatcagctcccttaaaaagacttccttttgggaataaatcgagttgatcatgatgtccagcaatcgcttggattctgctttgaattctctcttagccatctatccctctcctcttttgctcatatgatatacatatatcgttcgattctgttcacaaattaaataacacactgcctacacgatgtcaattgataaggcagcggtttgacaagcggcattccgcttcatataatgtgttgtgaaggtaaatttgaccaaaatgaggtggaaaggaatgaaaatcttatcaactgttcttaaaagagaattggcttaaagacgggagaagtctgcccttttttagacaagccatctcgggaacagtttgatacgatttgacatcctttcttgctgtattttaaatatgtagcgggtaaggtgtagtttgccttacccgtttttttgccggacaggatagcgatgcttcacgctgttctctttagatggcttgttttttcaaaaataagcctgaaggagagaatcatcatgagtattgttcatgtaacgaatttgacccatatatatggagaccgcatgatctttcaagacgccgggttccgcctgctgaaaggggaacatgccggtcttgtcggtgcaaacggagccggaaagtcgacattgctgcgcattttgacgggcagccttctgcccgatcatggaaacattgaatggcagccaaacattcgggtcggctttcttgaacagcatgccaagctgacggaaggcacaaccattcttcagtacatggagaaagcgtacggccggctgtttgaaatcgaaaaggaaatgaatgggcttgccgaaaaaatggccgatgccggagacaaccttgaagccgtcctgaaaagatacggagagcttcaggctgagctggaagcttcaggattttaccaaatcggaacgaaaattgaggatgccgcacaaggcctcggcttggcggaaatcgggcttgaccaggatgtcacggctttaagcggcgggcagcgtacaaagctgctgcttgccaaactgctgcttgaagagcctgatgtactgctgttggatgagccgaccaactatttggatgccgctcacattgagtggctgactggctacttgaaaaactatgagcacgcatttcttgtcatctctcatgacgaacgcttcttaaatgaaatcacgacggttacattccatctggagcatcatgtgatcaaacgttattccggcaactatcaatattttctgaaggagtatgcgcaaatcagggcacaggctgaagccgcatatgcaaaacagaacagggaaatcaaaaagttagaggcgtttatcgaccggaacagagtccgaaaggcgaaacaggccaaaagcagggagaaagcattacgcaaaatcaagcgaatcgaaaaaccgacagattcttatgtcccaagctttgcatttaaaacggggcgaaacccggcgatgactgtactcaaaacggaaaatcttgaggccggctacacagttccattatttaagcctctttccctgaccgtaagacggggcgataaaatcgcgattattggagaaaacggcgccggaaaatcgacgcttatcaaaacgctgctcggcgacctcaagcctctgagcggcatcgtcacagcaggacagcatttacaggcggcctatttcaggcaggaaagcccagcttctcatgatacaccgcttgaaaaattgcgggcgttctatcctgatctaccggaaaaagacatcaggcagacgctcgcggtatccggcttgacgccaaagcatatcagccagcccctttttacgctcagcggcggtgaacaggcaaaggtccggctggcggagctgatgctttcaaacagcaacctgcttgttcttgatgaaccgacaaaccatcttgacgcatcggcaaagcatgcgttaaagcaagcgctctgcgactataagggaacgattttgctcgtatcccatgaaccggctttttatgaagactgggtgactcatatctggcagattgaagcatggcgccgttaagagtaaaagccggcctttccaagggccggctttttttatttggacaatacaagctcacgaatggcgtgggcaacgccgttttcattattcgtacgcgtttcgtaatcggccgaagcttttacctcagggatcgcattccccatggcgactccgcaacccgcccattcgatcatggacatgtcgtttccgttgtctccaatacacatcacttcttcctgcgcgatgcctaatatgtcggcaagctgctgaacagcatttcctttacttgccgcagggtgaagaatttcataaaagaacggcgaacttttcaccattgtatagcgttccttgacgtcttccggtattgcggcgatcgtccggtccagcttttccggctcatcaatgtacatcgcctttggcgccagaagatcttgcgggatttcttcgatcgtccggaaccggagcggcactttggtgacgtatgattcgtaaacggtatacgggctgatttcccggtttggcgtatacaaataagccgaatcaaaaaagtgcatcggagtatcaagcttttggctgagctcatataacgatttcacatcatcatagcccagtgtcagttctgacacaacttcctgagtatgcgtattttgaacgagcgctccgttataggcgatgacataatcgccgtcttcatttaaattcagttcttccaggtagcggcttacaccgccgaggggacggcccgtgcagagaacgatttttacgccttgttttttcgcggcatgcagggcattccgtacttcctctgttacttcatgaagatcattcaacaatgttccatccatatctatcgcgattagtttgtacattttacactctccctgatcagaatcgagccctaacatcgtacttatgacccataccttctttattgtatcacagcttttcccggtcattttcatctgatgcccacggaaaaaacgccttacagcaaataaggcgtttttcgggcaagcttggcctgcttaaaatatttcttgcagaatcggatcttcatcaagaatgcgaagcgctttttcgcgatagccggcttcatgcaagtacgtatagcggttgggcttgacagtgtgcgacaaattgatcgcctcgcgaaactcatctttgttcagattcagcgttttgacatattggaaaaagcccgttctcgtaaacaccttttcaatccgctcagcccggtgatcctgtacatgggccatgatgtaggtggctaccccgacttgaatgccgtgcatctgcggttttttcgaaattttgtccaaggcgtgggatatcaggtgctcagaaccgctgatcggcgcgctgtttccgctgatttccgtagcgatgccgcccattgtcaaagaactgacaagctcttttaagaagatcggctgtttaatatcctgcatcggcgtacggacaaagctgttgaccgctttcttgctgagcatcgacgcaaacgcatttacatcgccgaccccgtgccgctcctcaaactcccaatcataaagggccgtaatattggacatcaaatctccgatccccgccaaaataaagcaatccggcgctttttgaataatgctcaaatcagctatgattccgtagggaacccttgccggaacggttgttttttttccttcgacctgaagcgagcaattgctgctcgcaaacccgtcattggatgccgacgtcggaatgctgatgaacggggtccgcttggaaaaggcgatgtattttccgcagtccacaacatacccgccgcccatggcaataatgacatcgcaattcccgatcgaaaatgcccgcttcaaaagctcctgtatgtccagattggacggcagcagaacggcttcaactttaacatgttgaaatgcggttttcagtgaatgctcatactgctgataggaaaaatcgtcaaaaaacatgatcgccttggcaaactgatgttttctcaatatctcatccaaccggccaagcacgccctcactaatgtccaaaaccgcggggatggctatgctggtaacctggcgcggcattagacgatccgccctttttctttaagatattgttcaatgtcttcaaatgtttcaacggctacaaatggcaccccctgctgacgcagcaaatcctggagcgcatcctttgcaaacgtaacatccgcaaatttagccgggtgcgaatccggttcactgtcgcctgcaaaataaaccgtctcatactcttctttcagcttttgaatgacctttgatttatcaatcccatagcgctcagagtaatgccaatgattctcatcaatgtccatatgaacattgtcttctttaaaaaagcctttatttgaatagacctcaacgtctgtaatcccgtatttctttaaaatataatgaatgtaataatccgtgccggcgcttaaaatgtagaagtcgccgccgcttttctggacatgctgaatgaagtcaggcacatattcatcaatcggtatggaatggatgtcatcaatgattttttgttcgctttgattaatcgaagcaaaaacggttcccaaaaattcgatatcttttaattctccggacttccacttcttgaacaattcacggccttcgggaaaatatttatcaatgaccatccagtaaaaatcctgtttggaaatcgtcccatcaaagtctgatacaaatgcccatttcttcatgctgcatacctcttttctatggtattttaaaagattagattcattatacaaaaagtttgtgaatcattgaacataatattatttcttttttgtgtactttcgttcacaagctgaatattcgtccccctgaaaggaggcgtatataatcattcttgatctgtacgctgcttacctttctctgttacggcaaatttccgcttcatcgttttgatgttttccgccttgcgaaatctgagcgcagaccagtcttcatcaattgcaatttggcgaaccggttcatagccctggtctgcaagcagtccggctactgtatcgcggctgcagtccgatcctttgtagactttcgatgattttttcgggtagcaaagccaaaacagaccgtcttccgccaaatgacgttcagcctccttggctaaagcctgcagctttgcgttggtcgctgcgaatacctgaacaaaatcatattggtccgattcggcgtgatgatgaacagggccttgaaattcagcgatgacgccgctgtatgcctcaggcggattcacaatcagtacaggctgtccattatccttgaactgcaattttttgatcaccgggttcgtttctgccatctctcatcagtcctttttctgtttatagtaacaaattaaccaaaaccacactaatcatacttagcaaaaaaagtgatagacgagagagggattgatctgctatatttacattgataatgcgaatcattatcacttaggaaatgtcatatgtttcacatcaacaggagggtcaagtgaaaaagaacttattgataatcggtttagttatgctgttgtgtatagtggtcagcgcctgcggaagcggcaatgcgtcaaacggtagcaaagaaaaagcggctgaagaaacgacaagaacatatcaatcaacgcgtggaagcgtgaagattccaacacatccaaagcgcatcgtgacagacttttatgccggtgaactgttcacggtcggcgccaatgtcgtcggctccggctcgtggtctttctccaatccatttttaaaggaccgtatgaaagatgtaacggatttaggcgacccgattaatgtggaaaaagtcatgaagctgaagcctgatttaattgtcgtgatgaacgatgataattacgacaaactgtccaaaatcgcaccgactgttgtgattccttataacacggcgaaaaatgttcaggaaactgttaagatgttcggcgacattgcaggagctaaagaagaagctgaacaattccttgccgatttcgaccggaaatcgaaagcagcgaggaaaaaaatcgctcaagtcgtcgacaaaaatgctactttcggtatttatgaaaacacagaaaaaggccaattctgggtgttcaatgacaacggcggccgcggaggccaagccgtgtacaacgcgctcggcttaaaggcgcctgaaaagattcaaaaagacatcttcaaaaaaggcgaaatcaaagaactttccttggaagtcgtacctgaatatgcagcagactacatgttcgtgacagactataacccgaacggcgacagcaaaacgctggacaagctgaagcagtcttccatttggaaaaaccttgacgccgtcaaaaacaaccgtgtctttatcaacgactttgacacgttctatccgtacgatccgatctctgtcagcaaacaggttgatttgattacggagatgctggtgaagcgcgaaaaggagaataagtaaaaaagctggaatttccagctttttttattgttttctttcttgaatgcttgaaaacctaaaagcaaattgaaagatcaaatagaaaggaatgtagaaaagaaaaaacatcatgatttgaaataataaccctttcaaactaaatggatatgaaatgtcatgaaacaaaaaagataatgccatccaaacgacaaaggcagaaaacgcagctttaaagccgagtcccctcttttttctcaacagacctttgctcacgagcctaatagaatagtagccgctgccgatgaaaaatagaatgatcagcaacagattgctcggtatttcgtatgctgtcgtgataaaaatggaaataaaaatcagtgaaagaaggagcacaaacccttcaaatccaatttttctctcctgttcagcctttttattttcattcattatgttcgcctcctttctattgttttccattaaaacaaacagaagccatgttaacaataatcatccataaaaacaatgatttgacacgcatgccgctgcttcagcccatcactcctgtttcacgtgaaacaaaaaatgcatcgaaaaaatatatggaatcaagtgtgtgaaaatgaaaataataacaaaaaaaggagagatgatgatgggaattgaaaaggttggacaaatcggggtgccggttcaagacttggagcgggctgcggcattttatcaggatgtattgggcctgtcccttttatttcagacagatcgcatggctttctttgagtgcggcgaagtgcggcttcttctcagccttccggaaaaagacgaatttgctcatgcaggctccgtcatttattttcaagttgaagatttgccggctgtatatgatgaaattgcaacaaaaggcgtctcttttccaatagagccgcatgtggtggcgaaaatcgagcaaacggaaacctgggtggccttctttgaagataccgaaggaaataccctagctttgatgagtgaggtgaacatataaaaatgaaaaacagctgatccctcagctgtttttcgtttttacatcatcacaagccgattgacaggtgcgatttaattcacaggcggcgcattttcctttccggcttcgtttgacaaattttataagcgtccatgccgcataactaaagataagcgctccgatcgtaatattaaacagcatgctgtcacatccttcctatgataacccaagcagtcgtccgccctgataaatcaggaacgcgatcgcatatgcaatggccagtccgtaaacaatggacaagaacatccactttttcgagtttgtttcttttttaatcaccgctactgtcgcgaggcatggtacgtataaaagcacgaaagccataaatccgtaagcggccaacggtgtaaattgttcagccatcatgccttgcagctgggcttcgggtacaaaatagatgatgctcatcgaagcaacgacaacttccttcgcgagaaaaccggttaatagtgatgccgctgcctgccatgtgccgaatcccagcggcagcaatagcggtgcgagcactcccccgatcatcgctaaaaaactgtcatccatcgcaacgtccgttccgccgggtcccgtatacgacagaagccaaatgaggacagacccgccaaaaatgtaagtgccggctttgcggacgaagcctttgcccttctcccatgttgcccgccacaatgtacgcgcttgaggcaaacggtacggcggcagttcaatcacgaagaacgacttttcttctttgagcttggatgaggataaaaacttcgccagcactagcgctgcggcgatgcccagcacatacaaggaaaggacgacgaaagcctggtgggccgcgaaaaaagcccctgcaaacagagcataaaccggcagccttgccgaacaggacataaatggcgtcagcataatcgtcaagagtctttccttaggctgctctacagtccgcgcagccatgacgccgggaacattgcagccgaagccgataatcagcggaataaaggctttgccgtttaaaccgatcgcctccatcaggcggtccatcaccatggccacacgcgccatatatcctgaatcttcaagcaccgaaatgaagaaaaacaggataaagatctgcaggacgaacacgagcacaccgccgacaccggcaataatcccatcgagaataagcgcctcgataaacgggctggctcccattgccgacagcgccgaggccgtccattccgtcagcggtcccccgatgaaaccgtccagtgcatcagacaatggaacgccaaaccaatcaaacgtcagcatgaacatgagatacatgaacaacaaaaaaatcgggatgccaagcacctgatgcgttacgatctgatccacgcgttcagtcagcgtcagttttcgctctgactgatattgcacagaagttgacaagatgcggtcaatccatcgcgatctctcattgtaaatatgctgatgcagcgatcttacggaatgctcctgatgaaggcgtttttcggtctcctcgtaaatttcctttaatctttcgctgtcggccgcgtcctccagctgttctttcattttcgagttgccttccaaatattgaagggccatccagcgctttaaaacgccggggagttcgggtatgatcgattcgatccggccaatcgcttcttccactgcgcttccgtaattgatgacgagcggctccgccctcttttccttttcaaaaagcaaatgcctgctcagttcatcacatcctttgccgctgcgggcaatcacaggaattaccggaacacctagcgcatcagacattttttgatgatcaatgaagacgccgcgctgtcctgcgacatcgatcatatttaaaccgatcgtaagcggatgcccaaattccaggagctgcacggttaagtgcaagttccgctttaactgtgatgcatcgacaatattcaatatatctgaaaatgaatcattgagcaggaagtctgtgacaaccccttcatcgcgggacagcggactcaatgtataaacaccggggagatcgactatcattccttgtttatgacggagcagccccacctttttctcaacagtcaccccgctccagtttccgacatactcataggagcctgtcagcgcattaaacaatgacgtcttccccgtattcgggtttccgaaaagggcaatctgccggctgttcatagcttttcaatcctgatcttttttgcttctccaagccgtatgccgagacactgcccgcctgactcgaacatgaacggaccgccaaacggcaatttgcgcttcacgcaaatttcatcatcttctttcattccgagctgtatgagtctgcgctgaacaagttcattcacgtctgaaaaatctatgattcttgctctctctttttgttttaattcggctaaaaccatcgttgaggcctccgtattctgaaaatgataatcgttatcataatatgattataggcaataagtcaccttccatttaaaaggagatgtgtcaaaaccggaacatttttatgagaatataaaaaagcgaaaaaccccggcgatacaatctttcgctctggcttttcgctctatcaagttatgtcgttaacctgcatgatggcgcactttttgctccattcgcctctttttcggcacataaatttttccgacaaacatatagccgtacttcaatttattgacggcccaggatatgaaaaccgcagcgcctgtagaaatgaaaaacaaaagcaaaacagccgataccgtaccgatgctgtcaagggcggttaagatgaccaacccgaaaatcaggataaaagcgtgcagtaaataaatagaaaaagaatagttgctgatcatcataatcagcttcggtaccgacttcagttttgaaaacaggtggaagcataagaaaatgatgcttgtcgaataaagcaggatatccggacgctttgacgtcaccgcgatgtcttggccgaagtaggaaaccgctacaatgaaacatccggtcacagcagccgccgcatacaccgcatgcctgtaccgttccagcaatgccaaaaagcgctcgtaattcttgccgcaataataggccaaacaaaagtaaaagagccagccgggaaacggcacccacgaaaaaggaaacggcgcctcctcctgaacgaccggaggttgaatgaacgtgaaatagctcaaataagccgctgtgaccgcaaaagaaatcgaaagcacccatttaggcgaagccttttgcaaaaatgaatggaagcacatgtgcagcaagtaaaattgaaaaatgacgagaatgaagtaaccgatgaaattccccaagaatatattcgccaacagttttttaataatgaccgatgcatgaaattgctgcatcatcagacctgcggtcataaaagcatccaaaacagcgataaatagaaaagggatgaaaattgttttaaaccgcttttttaaaaacccttccggaacaccaccaggataggcatgcgcgagcaaaaattcggaaatgaaaataaacgccggcgtactgaacatcaggagcgttctgaaagattcaacaacccggaaaaccgcatctccgagcatgtccgcccgcaccatgagcaccattgatatcgcatgaagcaaaacaacgcttaaacaggagatgcagcgaatgacaaaaatttcttttacttgcaaatcgatcactcctctttcaaatttgaaataatatcaaattaacataatcatccaaatgaaggaagaggcaaaatacataggtatgtttatcccaaatttgccggctgcaagtataaaaaaaagattagacacgtagtctaatcttttttaaatcgccgcttttatctgttttgtatagtagaagcggacgatgaagtaatatatgacctggatggcgaagaacacgccgagcaccattgcagattccttgaagaggttgtactgaaaggcatgcgataaagcggtcagcgccacagctccatggacaagggcaacagcgataggcgcgaagaacaagatgccgatctgcctgttcagcactttatgcagttcgcggtctgttaagcccattttggcaatcgatttgaatttctgcttatcatcgtccaaatcagtgtacaaccggaaatagaggaagcttcctgctgaaacgaagaagacgattccgataaacagtccgacaaataatatcgggccataccctttgcttatattatatacctcataatctacagccccgaaatacatgtaatccagtttcttttgcaaagcctccccggctttcactaaagccatgccgtcagcttcttttgcctgccatgcatagaaccggttttcgcttttcggttttttcagctgtgcgaaatctttgtctgtcacaatataatagctgggttcagataacgcttttgaacggatcgtttgatcagccttcagttgttttccatttgcaaaagggattgacgaagggagctgctggtcatcatctccctctaagccgatcttgacctcatactcggcagccgccgcttttccgtcttcaagcttgacgtggtcggctccgacgagatcggcaaacttgttatagtcagattctttcacaatcagcatgtcattgccgccgacatcgaaatattgaaggacagctgaagctttgtctgttttgatatttctttcatccagtgtgtcattgatgaaagccacgtctttttcgatgtgtttgtttgtttccggcggcttatatgagaacgtatgcgggttcatctctttaattccgtttgtcaccagagtttggaaaccgtacagcgtcccaatggcgctgaatgcgacagtagagataatggccaccataaaaaacgtccgcgaattgtctttcatcctgtaagacagatcagaaaacaaaatcatattcgttttccgccaaaacagggtttcccgttttttgagcctgcggatcacataaacactcagctgcgtaaacagcagatatgtgccgataatgacaacaatcgtcaccggcaccatcgccacaagaacgcctccttctttgacaatcaaagcggtgtaatagcctccggcaagcagcacagcagcaaccagcgtaagcaaggcagatgctttcggctcccctttggagattttgttcccttttaacagaacaatcagcttctcgctcctgagcacaaacgacacaagaaaagagataaataagaacagaccgttaaaagaaataaacgtcacaatcatcgccatcaacgggaagtaaaaatcgagcttgttatcaataatcaggacattttccgcagtgagcagtatcaatttggcgaagacgagcccgagcacaatcccgccgattgtcgcaaaaaatccaatcagcatattttcaagaaataccatcatgcgaatttggcgcatcgacatcccttgaatcattaaaacgccgaattccttttttctcgattgaagaaatgaactcatcgagtacagcacaaagaaaaaagagaagacaaaaataatgccgccggcgaccagcaggccaaaggatgcatgctgcccgatgccggaagtcaaagaatcactggtcatcaccgggtggaaagcaaaaatcgcaaatgcgaaaaaaaccatcaccgtaaacatgctgctgagaaaataagcggcatacagccttttgttgcgaatgacattgttaaacgcgaactgacgaaaggtcatttgcatcccctcccaacaaggacagtgtatcgagaatcttttggaaaaacgcttggcggttatcgccgcggttgatctccgaatacagctttccgtccttaataaagacgacccggttgcaatagcttgccgcctgagggtcatgcgtgacaagcatcatggtcgctttttcattgcggttgatcgactcaagcatttccatcacatctttggatgactttgaatcaaggttgcctgtcggctcatcggcaagcagaagcttcggcgaatgaatcatcgctcttgctacagcggcgcgctgggcctgaccgcccgatatctcatatgtgcgctttttcatgatctgggtaatcccgagcttttcggccaattcgtttgccctccgcttcatttccttgaccttttcgccgtcaagcgtcaaaggaagtacgatattttcttcaacggttaatgtcggcagaagattaaagtcctgaaacacaaatcccagctctctgcggcgaaatttagccaatttttcttttttgagaacatgcgggttttggccgctgatcaatatttcgcccgtcgtcggctcatcgatcgttgcaatcatatttaatagggtcgtttttccgcttcccgacggccccatgatcccgacgaattcacctttatcaattgttaggttaatatctgttaacgcgcggtacgcaatttttccttcgtaaatcttactggcttgtttgacctgaagcatcacaagatctcctttcacctttaactttcgatctgtgaccagtttacctaaatctcttgttgatgaactatcgattcttctttcactttcattacatcgatgtaaggttttgcgtagccgtgaaaatcagccgaattgtcgtgcctttcccttcttgtgaatcaagttcgatccggtggccgagctggtcagccgccgattttgccaagtaaagacccattccggtcgattctctgaaacggcgtccgttttctcctgtgaaaaacgggtcgaaaacccgcttttgatctgtatccgggatgccggcgccgaaatctgccacttccaataccgcttccgaatcattttcgtatacagaaataatgactgtattgcttttccccgccgaatatttgaccgcattgttgacaaactgggaaatgatgaaaaacagccacttttcatctgtttcgacggtgatgccttttttgatttctttgaacttaggataaacttgactgcgaatgtaaaagcgcttattttcgcgattgacctcgtgaacgatatccgccaatgcgaccggttttatacggaaatcctgttcgatcgtccgcagtctggccatatagagaatcgtattgaggcccgttttcatccgctcggtctcctcgcggatgctggatgattccggttcatccaaattttgagccgtcagttcgatgaccgacaacggcgtcttcatttggtgcacccattgatccatgaaagtcaaatgctctttttggccaagctccagcttctttaattcttggcggtattgcttgtactggcttttcagcagctgttcaagcgcttccgacaaaggggattggggctgattcgattgcctgaaggtgtcatccaatgactccagcccgctcgtcatccgtttgtagaacttccggcgcgtatagtaatggtagaaaagatagaagccaagaaagaaaaagccgagaaaaacggcataaaaagccggtctgatgtgctgatacccatcaagccagtacactgacagcattgtgataaactgcagcgcctgcacggcaatcaacaaatagtgctctttgaaaaaaagcttcattcctctcccgccttcacccaggatacattcaagcgatagcccgcgccccgcactgtttccactgcatcttcaataccgagctcctgaaacttttttctgacgcgcgtaatgttgacattaagcgtgttttcatccacatatgcctgatcatcccacagcttggccagcaaatcttcgcggcctgaaattctcggatggcgttccattaagctttcaataatatccgcttcttttttcgtcaaagcagccgtttgaccggcaaatgtcagttcaagtctttccggatacagccgcagcccttctttttccagcagccgttcctccgccttcgccgcgtattcgccgtaagccctgcgaagctggctgcgtatttttgccatgacgatctcggcgtgaaacggcttggtgataaagtcatctccgccgttttccaatgccatcacctgatccatttcacctgtccgcgcagaaataaacaagacggggcaaatcgattcctggcggatttgccggcaccagtagtagccgtcaaagctcggcaggttaatatcaagcagaacaagatcaggcgccgtgcttctgaactcatccatgacacggtcaaagtctttcactacatgaacgttgtatccgtatttgacaatatgcgattttaacaaatctgcaattttcgggtcgtcttctacaatcatcactttttgcatctcggtctctccttttggtttggatatattatgacacgaagcggtctgataaacaaaaactgccgcgatccatcctaccttacaatcatgtaagtgtattgtaataggaatcaatatcttctctctgcgcttttttataaaataataccatccacaaaactgaatgaaagaggagacggtatatgaagacacgggcgggcggcctgattgccgcggttctgatcgccgttgccggcgtttttatcctgcagaaagcgacaggaggccttgtgccgctggccgatgattatatacaaggccagggaaagcctgaggcttattatctcaaagctgaggatcatgcagaaaagccggataacggaaagtacaactacacattaaccggctatgacgcgagcggacacaaacagcagattgaggcagaggcagacgaaaaactgcatcccggcgctttcatcaaagtattggcgtacggaacgaaagccaaaagcttgactgaagtacacgaagaagaaatccccgagggcgctttggctgccatgaaaaccaattaaaaccccatcgccggatggggttttctgcttaatatttaaatcgattgataatggtttgaagttcttcagccaattgggacagcgattccgctgcatatgagatttcttccattgaagccagctgctcctgggttgaggaagcaaccgcttttgtgctggctgacgtttcctgtgatccggaagccaatgtttgaatggtgttttgaaccatttcgacacctgatgtcagctgctgagtagaagccgcgacttcttggatttgagaagcaacctgttccaccaagtttaaaatttcgttgaaattaccggtcgtctcctgcgacaaagctataccggagctgacattttcttgaacgactttaatattatttaccgtttctaccgattcattttggatcgttgtgaccaatgattgaatgtggctcgctgacttattcgtttcgtccgccaatttccggacctcttccgccacgacggcaaacccttttccttgctctcccgctcttgctgcttcaattgccgcgttcagcgccagcaaattcgtctgctccgaaatatcggtgatgagcgaagaaatgttgctgatttccgccgtgctggacacgagcgcctgcaggccgctgccggccgagtcgactgacttatcaatgaagttcatttgttcgagcattttatgaacggactcggagccgatttcggctttgtctctcatcgaagacgacagatccgctatgctgcctgtattggaggcaacggatgataaacggtccagcaattcatgaattgcttctgaactcttttctgtcatttcgctttgcgtcatgttgctgtcggcgatcgcctgcatctcttcggaaatcagttcggaagtcgatttcgattcctccgcgcttgcggacaactgttcagaggatgcggcgacttgctcagacgagctgctgatctgcttcacaatttgcgtcagcgactggacaaaagcattgaaagaattggcaagctggccgaactcgtctttatttttgacgatcacttttttcgttaaatccgcctcgccgtgggcgatgtcctcaagctgctgattcaggcttctcaacggtaccagaatagacttcaagagcagcagactcaaaacaattcccaatatcgctgatactcctgtgacagcgatgatgacccattcgctcatcgtcccattggctctgatctctgctttcagatcatccacctcttgttccaggctttcgaccagctgattgacagacggatcgaggacatcttttcttaatgttctttcctctccgaaatggatcgattccgcttttttaaggcttgaagcgtaagtctgcatgacttgttgatttaaatcccaataagccttgaagttttctttaatttcttcgacgttcgctttgtatgatttttcccggatcagttttccggcccggtcaagactctttaaaacatcgtcggccttgtccttcattccttcactgtattcatcgtctccggtcataataagggctctctcgtcattcgacaagccggtcagacggtattgaatatgcttaatctctttttgaaattccatcttgtccttaagttcttcattctttttcaccgtagaagaaatcataaaaacagaggagattccgattccgaggattgaaacgactagaattgatatgattcccagcagttttgttttcactttcattatggtgatcctttctcctttatgtcatcaatgatgaaaaacagttttcaaatcaaacatcttcttccctccatagtatcgacatatttcgtcaaaatttgagaaggtgcagaatataagccgaagaaaaagctctgccgggaaggcagagcttttaatgaattggtttacttggcgggcccgccgatttggtatgttcatagaagtggtgaaaataatcatttgtctctgctttgatgactttccaaagcagcaggatggcgatcaggtttggaatcatcatcagcgcattcgccatatcggcaaacgcccagacggtgacgaggttggcaaccgtcccgatgccgcaggcgaggatgtagaccagcctgtagcccgcaattcctttggcgcctgccaaatattcgaagcacttttctccgtaaacataccagccgacaattgtagagaagccaaagaaaatgaccgacagagacacaatgtattcgcctgccgcgccgagtactgaagcaaaagctgcgcttgtcaatgccccgccttccaggctggcattatgggccacgcctgatatcaagccgccggacgggtcccagaaaccggtaatgataagggttaaaccggtcattgtacacaccacgatcgtcacgataaatgtcccggtcattgcgacgagcgcctgttttaccggatggtctgcgcgcgcatttccggcgattagcgccgccgtcccaaggcctgcttcgtttgagaaaataccgcgggataccccgttccgaaccgcttcagatacggcaattccaaggaagccgccggctgccgctacagggtggaaagcataataaaaaatcagcgcaaaagccggaataatcttgtcataattcaaaatcagaatcaagatcgccccgcccatgtaaagaaaagccatgatcggcacaaagaagctggcaacggtgctgatccgctggatgccgccgaagataatgacgctgacgagaatgacgagaatcagccctgtcacccagttttcgatgccgaagctgttcttcgtaatatcagcgatcgtattggattggacactgttgcctatccccaaagcggcaaaagctccaaacagcgcaaaggcgatggcgagtcctttaaatttgcggccgagtccgtgttcgatataatacatcggcccgcttgaatattcccctttttcattttttacgcggaatttaacagccagcaaggcttccgcgtatttcgttgccatccccaacagcccgacaacccacatccaaaagatcgaacccggtccgccgagtgtcaatgccgtcgcgacacctgcgatatttccgtttccgatcgtagcggcgagcgctgtcatcaaagccttaaaatggctcacatccccttcggcagccgcgtctttgctgtcttctttgccaaacccgatcttaaacgcatagatcaggcggcgaaattgcagtccttttaaaacaatcgttaaaaataagcctgtcccaaataataaaattaaactgggcggcccccatagtaccttattaatcttgcctagtatttctaagatatccatatgactcactcctgacaaagataacgctttcatagctgcatgagatattctatcacaatggaaaatggttatgtttgtgaaacgacacaaaatgtaatcgcttacatttgtttttttaacaaagctattttttaaagaaaaaaattttaatagataacttatctcctcaagcctttcaccttattcaacgttcaccaatttgttaaatttcacaaaaaagcgcttacatttttaattttacacacgatgctcttcccgattcagagatttatactagcggtagaatcatatttcatttgagggggacgacatcatgatcattggaattcctaaagaaattaaaaacaacgagaaccgtgtagccattactccggccggagtagtcgcgctaaaaaaaagcggtcatcaagttttaattgaacagggagccgggcttggaagcggattcgaggacgccgactacaaagcagccggggcggacattttggctgaagcgaaagatgtgtggggaaaagcggatatggtcatgaaagtgaaagagccgatcagctctgaatacggctatttccgaaaaggacttgttttatttacttatctgcacttagcggctgaacctaagcttgcgaaagcgcttgtggacagcggcgtcacagccatcgcttacgaaacggtcgaagtgaaccggacgcttccgctcttgactccaatgagtgaagtcgccggacgcatggcttcgcagatcggcgcgcaatttcttgagaaatcaaaaggcggcaaaggcatcctgttatcgggcgtacccggtgtaaaacgcggcaaagtcacgatcatcggcggcggagtggttggtacgaacgctgccaaaatcgctgtcggacttggcgctgacgtcactttgatcgacttgagcgctgagcgcctccgtcagctcgatgaccagttcggcaaagacattcaaacgcttatgtccaatccgctcaacattgcggaagccgtaaaagactcagaccttgtcatcggcgccgtcttaattcctggtgcaaaagcgccgaagcttgtcacagaagagatgatcaagtcgatgtcgccaggttcagttgttgtagacgtggcgattgaccagggcggcattatcgaaacggttgataaaatcactacgcatgacgatccgacttacacgaagcacggcgttgtccactatgccgtcgccaatatgccgggagccgttccccgtacatcaacgatcggcttaacaaacgtcaccatgccttacgccttgcaaatcgcaaataaaggcgttgaacaagcagtcgccgaaaatcaggcgctcgctctcggcgtcaacgttgcaaacggaagcatcacctacaaggccgtcgcgcgcgaccttggatatgaatatgtatctgtagaagatgcatttcaaacggtaaccgctggttaagcggattttatctcttgagaacattttaacaactctttctgactgtcctttcacgaaaaaaggctggatgatatccggccttttttccattctgctttaaacattcaaggccgctttccggcaaacggcgtcgccttcatctaagaaaccggccacaagtcaatttttgaatggtgttcccgtatcaacatattgaaacacatgaagcgacggcaatggacgtcctttaaaatcaaacaatgcctgattgtctacggcgctgccgccaaaccactttcctgcgtcttccgggtcatattcagcagcatagcttgtagcccagcctgatccgtatgtctcccaaagcgctttatttttctcgagccggtgagccggtcctaccggaatccatgccggttcccaatagaaaacgccgattccggcttcacctacgtcgctgaccgcttgaatcacatcacggaccgcgttcgcctgcccttgaacggtgaccggataattcagcgtttggccgtttttcggagctgtatttccgtgtccgtctccgtcttcagccgtatacgtataagatgtctcagcaaccatgacttttttgccgtacgtatctgcgacagatgtcaggacggatgttaaattcttcagcgtgccatgccaaaacggataatacgagcttgcaaacacatcgtagtctacatgatgccgatgaagcgtctcggcaatccaagcgtaccttcctgacgtctccggattggtaaaatgcaaggcgactaggatattcgaatccgtctctcgcaccgcttgactcccggcgttgaataattggctcatcttcgcccaatccgtttcaccggcaaggcccccgtttgtttcgttaccgacctgcaccatgccgatgtcgatgcccgctgctttcatcgctttaaggctttgttttgtatattgataaagcgccgtctttttatcttcaaagtttaggttcgcccatgctttcggcgctttctgtttcgccgggtccgcccagaaatcggaatagtggaaatccgccagcagcttcattccgttggcagtggcccgttttccgatctgaatcgctttttccagatcattattgccccctccgtagccgttgccgttggcatcatagggatcattccatatgcgcacccggacataattgacgcctgcttccttcagcgttttgaatatatcctgtttctttccggattcattgtaaaaggcgacgccgctctcttccaaagcgatgatgctcgaaacatcaaccccttttataaaatccttgcgaagccctgaaaccttttcaacataaaggccgctttttgccgtccctgaatctctggcggcttccgccggaccgcttgttccaaatgcgcccaaaacaaatatcagcaccacaaaaacagccagcacgttcttcatcaatctcgcttctcccctttcataatagacacacaagcaaaaagaaaacgctttcattattcacccggagaaacatccaccttaaagcggatgtcctcccaggcctattcttttgcttttaccgctattctggcctcatatttttccaatgtgacttcgccggccagcgtttctccggtcagcatatctttaactgccgacgccaacacgacgggctgacgtttttccgtgaaattcatgatgaaaatatagtcattttcctcatcctgtctgacttgaacggagacgccaggctgatgtttcacgtcaagagccggttgaatcgctagctctttaatcaatgttccataaaaatcccgatgaaattggctgcttaaacgcgcaccgatataatacgttttcccctgtttgtatggatggctcgtcacagccgtcgtgtccgcataaaagtcgtcctcatagaatccctcgggatctgccgtactgagcttcagcacggtcgcgtaatcttttagctcatacgaccggttttgataacggaccgcatttttatcgcccggatagagtgtatcggtttcaacaggctccatgccaaacatctcttgcagatcttttggccatccgcctaaataggtcagatcagattcgttgacgattccgctaatataggtcatcaccaatgtgcccccgttggcagcaaatgcctttaagcgcgcgattgtttcttcgcttgctaagtaaagcatcggaacgatcagcagccggtacgatgaaaaatcctgttccttcgtaatcacgtcgactggaatatcacgctcccaaaacgcgcggtagtgctcgtgcagggtttggggataccgcttggttttcatcccgaatccttgtgcatcttggagcgcccaatggttttcccaatcgtagagaatcgcgacatccgcaggccggatcgttccggtgacttcagacagcgcttcaagggtttgcccgacttttgccacttctttaaacacgcggttctcggaacaattgtcatggccgacaaccgcaccatgaaatttttccgatgagccgcgggatttccgccattgaaaatagaggatgctgtcagatccgtgtgcgatcatctgcacagaagacaggaggtgcatgcccggccgtttcgctttattaaaatcgtgccaattgacagcgcttggcgtcgattccattaagagaaacggctgctgtttcaggctgcggtacaaatcattgataaagccgactttcatggccaaatctgctgtgctttcccaatcgttgtgccaggcgggatacgcgtcccagctgatcacgtccaggtgcttggcaaacttgctgtagtccagcccttgaaacggaattaaatcatgcgtgtccgccataaaattggtcgtaatcggaatattcggcgtgatttcctttaacggaacgatttcattttgaaaaaaagagatcgtctggtcagtgacgaagcgtcgccagtctaaattcaagccgtgcaccgcattttccccgatcggagacggcgattcaatctgtgaccaatcgttgaaggtgtggctccaaaaaggcgtccaccatgcgtcattcaaagatttaatatcatggttgtacttctttttcagccagtctctgaaggcgtgctgacattgatcacaatggcattctcctccgtattcgttggaaacatgccacatcaaaagggcatgctggctgccgtacctttcagccagcatgcggttgatctctttcgttttttcacggtatacgtatgaagtgaagcaatgattgtgccttccgccgtgcagctgtttgacgcgttcagcattcacgcgcagcacttccggatacttttgcgacagccaagcaggacgggcgccgctcggtgtcgccaatataatccggccgccgttccggtgaatgctctcaaaaatatcatccagccattcaaacgtatagacgccttcctccggctcaagggcgctccatgaaaaaatccccactgaaaatgtattcgtatgggcaagcttcatcagcttgatgtcatctgcaagaatatccggacggtcaagccactgatccggattgtagtctcccccgtgaagcatgtatcttgcttgggtcgtataaatttttggcataatactctccttttttagaccattttctccttcggactatcctttcgttccgcctgccgtcaatcctgacacaaagttcttttgcagcatgataaagatgacggctaccggtatgctgatcaaaatagcgccggcggcaaacgtcgtatagctggctcccatcacctcattgactaaattgtataaaccgatcggcaatgtatacgactccggtgtccgcaatatcgtcgaagacaaaacgaaatccccgagcggcccggtgaatccgttcatggcaacgaccgcgatcatcggtttggatagcggcataataatctgcaggaaaatccttgtattgcttgcgccgtcaatcttagcgctctcatccaaatcgatgggaatggagtccatataccctttcatcaaatacgtgttcatcggtatgagcccgccgatgtacagcaaaatcagcagccaatggctgttcatcattccaagcatctgcgctaaaacgaagagcgcaaccaaagccgaaaattgaggaatcatttgcagcagcaagaataaaactaaagcgtttttccttcctttaaaacgaaaccgtgaaaaagcataagctgtaaaagaaacgctgatgaccgatccgatcatcgtaaagatgctgattttcagcgagtttatataccattgcccgtattggaggctctctttgccggcgaataattctttatagtgatccaatgtcggatttgccggaatgatagaagtgctgaccaaactgttgccgggattaaagctggcccccaccgtccaaagcagagggtatatgataacggctgtcataaaagccaacagagaataggtcagaaggagccgaaagaatcttcttttcttcatacgttaagccccctctttgaaagaatttgtccgtctgaactgccacagtgcaattgagatgacaaagaccgacagcaggatcgtcaatgcggcggctaaagagtactggctcgactgcatcgtcaatttgtaaatccaggacaccaggatgtcggttcctcccgctgttgacccgggaacagccggaccgcctccattgaatagataaataatattgaagttattaaaattaaaagtgaattgcgtaatgataatcggcgccatcgcgattaaaatcagcggcagtgtaatatgcctgaatttcgaaaacgcagacgctccgtcaatcgtcgccgcttcataaaggtcatccggaatcgactgcagaacaccggttgttacaatgaacacatacggaaatccgagccagccctgcataagaataagcgccagcttcgtccaattggcattcgtcatccaaggaatcggatcgatgccgaatgcggcgaggatttgatgattgaaagcaccgaagctgtcattaaaaaggccggcaaacacgagaatggtaacaaaaccgggcacggcccaaggcaagacaagaatcgtccggaaaatttttttaaagcggacttccttctgattgacgacaaccgccaacaaaattcccaacccgacttggagcgtggaagcgacaagcgtccaaacaatggtccaagctaaaacatccaaaaaggtcgaccgccaaatatcaacggtgaaaatttcggaaaacgttttaattcctacccaatcgacaaggcgggcaggcggagaatggtagaggttatagtttgtaaaagctaatgcaaagctgaacaaaatcggaaaaacaacggcaaaaaccaggatgaacagcgatggcccgctgatgagatacggatatccctgagctattaaattatgatattgttccttgagtgaactgagctccttttgttcatcgcgcctctttccgttttggtaggcgtcccgcaaattggcgtaatagacagccagcccaaaacaggtgacaatcacagcaataatgccttctgccaatagaaaaatcgagttgtcgcgcggcacttcggttccaagcgtaaacaggccccacagccccatattcagcaaatcgccaaaaaccgcaaagaacgagacgcctaaaagaaggaataacagaccctttatccattgtttattgtagaattggcccagaccgggaataattgataatagtaaagcttttttgcgatgctgcaccttctccttcacctctttatatggacgtgcttataataaatggcgccaaacttaagacaagtttgacaccaccgcccgcggcttatttgctgccgctgtgcttcgctttgatctgtccttgtatcgtttccgcggcttgatcaagcgcttttttcggttcggcttttccggttgcaattgtttgcagagccgcatccgccggcgtccatacttcattcatctcaggaatattcggtgtcaactctgagtactgagattgctcggcaacggcttgagccgcttcgctttttgtgacggcaggatcatccgccagttctttgactgcgggaacttcttttgtgatctcatatctcttctttgagttttctttattggcgaggaagacgactaattgttcggctagatcggcattcttcgaataagcgcttacattgtagctcttcacgccgacaaaagaactcatatgcttgccgttggacagtttaggcagcttggcaaccccgtaattgatacccgcttttttgaacggttccaggttccacgggcctgaaatgatcgctgctgcttttccttccgtaaacagcgattccagcacattgatgccctgctccccaataattccggcagggaacagcccctcttggtaaaacttctgaatgtactcggcgccttcgactgcacctttgttgttcaagcctaggtcggccggatcataagtgccgtcggcatcgcttttaaaaatgtagccgccgtaccctcccatgacgctctgtgcataataaatctggtcaaacagcgccaggaagccgaattttttgccgtcagccgtttttttggaatactcataccattcatccagcgttttcggcagttctttttcagaaattaaatctttattatagtagagcatcgtcgtttcgaccgctttcggcaggccgtagaccttgccgtttgtcacctgcgatctcatggcaggttccgtatagatcgattggatctctttgtccacctttaattccttgatcaaaccttccgttaccgctgtcccgatttggtctccgggcatcgttaacacatccggacccgttcccgccggtccatccatccgcaagtcttcgatctgctttgcgtaaggcttttcaacgactttgacagatacgccgtgctctttttcaaattgggcgacggcatctttaatgccttcgcttttctctttatcttcccagaccacgagttccttttgcttcgagtctgatgctccattgctgctctctttaggcccgcaggcagttaaagacaaactgagagcaatgacactgctgattccaacatattttttcatattcatcatttgtctcattccttttattggagtgaaagcgctttacaaaaacaatatagcatgtcttaggaaaagtgtaaacaattattttacttaaacaggtaaaatgttttacgaaaaaagcgcggcttgtgaacagcagcccgcgcttttttaattggtgcttttcctgaccaccagttcggcaccgatatatagcgtttttacagcttttcttttttgaagtatttgttccaaaagcaattcaatagcgtttttgcaaagctctttaatatcgatatggaatgtcgtcagcgggggagatacgtatttcgctacactgatgttgttgatgctgatgatgctgactctgcccgggatggcgatccctttttcatttaaggcctgaaggcagcctacggcaatcggatccgccgctgtaaaaaaggccgtcggcagcttttctcccaatgtttcaactgctttgtccatcagatggtagccgttttccaccgaaaaacccctccggcaaaaaataaagctttcctccaagagccctttttccttcatatattcgcgaaacgttcgttcccttacgtccatttcgtcttcatctgtattggggttgtggtacgtacctccgataaagccgatcttttcatgccctttctcaatgagaaaatctaccgttttcctcgtcatctgctttaagtccggcctcactgaatcaaagtgattcggatcaggcgtcgaatcgataaatacaccgtgaggcgtcatctgtcttaatcggattaattcatcatctgaaaacgagccgacggcaatgaatccttctatgttttcgggaatggcgtcaatgcctcccgaaattttatacgttgccagttcgacgttgaattgctttgcgagcttctcgatttccagcctcatcgttttaaaatacacgtcttcgagctcttccttatccgtcagccagtacagaaacgcgatgttttttaccagtgtcctgatcgttttcttgcggtagttcaggctttccgccacttcaaatattttctcccgcgtctcatcgggtacggaaaggctttcgtcgttattcaatacgcgggaaaccgttgagatggaataccccgccttttctgcaacatcttttatcgtcgccacgattgtaaaacctccatatgaacacctttattttaaatatcaaattttttagtaaaatattttactaatttaacgttgatttgcgtaaaagtcaagtgctgattgccctatccccgccaataaggattttacatgaaaacgcttcatttgaaaaaacactttttattgcaccaatcgaaaacccgtagtaaactggggttgaacttaattaaattaatttattaagtctggtacgtcaaacgaataggaggatatatgaatactgcagccgctttatcaaacgactttcgttctatttttaagacagaaaagacaccgcgaaccttttttgctccgggaaggatcaacttaatcggcgaacacacggattataatggagggcatgttttccccgcctcgatttcatttggcacctatgcccttggcgtgaagcgcgatgatcaaatgatccgcttctattcaaagaacttccctgacaaaggaataattgaatgcagcttgagcgatttagcctttgaccagtccgacggctgggccaattatccgaagggaatgttccttttgacgaaagcggcaggccatcaaatcgttcacggcgccgatattttgtattacggaaatattccgcacggagcgggcctctcttcttccgcatcgattgagcttgcgacaggcgttttgttaaaagggctttatgatttgcagacagacacgatctccatggtgaagctcggacaaaaagtcgaaaacgaatacattggcgtggggagcggcattatggatcaattcgcgatcggcatggggaaaaaggatcacgcgattttgctagactgccgtacacttgattacacatacgctcccttcgtgttgaaagaacacgatgtgatcatcatcaatacaaacaaacagcggacgctggccgggtctaaatataatgaaaggcgcacccaatgtgaagaggcgctcggcgatctgcaacaggagttgtcgatcgcaagcctgggcgaattgacgatggaaggatttgaagcccatcagcacctcatcagaaatgaaatcaatcaaaaacgcgccaaacatgctgtctacgaaaatgcccggacgctgaaggcgcttgaaaaacttcgcgaaggcgacctcgccggatttggcaagctgatgaatgaatcccatttgtcattaagggatgattatgaagtgacggggctggagcttgatgccattgtccaggcggcctgggaacaagacggtgtccttggcgcccgcatgaccggcgccgggttcggcggctgtgcgattgcgattgtagaaaaagaccggacagacagctttaaagaacgcgtgaatgccgtctaccgcgaaacggttggctatgatgccgctttttatactgcggcaataggcgacggcgccaaagaaatatagaaaggggaatggatatgagcgtgttggttttgggcggtgccggctatatcggttcacacgccgtgtaccaattaatagacagaggcgaaaacgtcgttgtcgttgacaacctcgagaccggccaaagacaggcagtacatcctgatgcgatcttttatgaaggggatgtgcgcgatcgcgatttcctccgcacggttttcgaaaaggaacgtattgaagaagtgatccattttgccgccagttcacttgtcggcgaatcgatgaaagatccgctcaaatattacgacaacaatgtatccggaacacaggttttgcttcaggcgatgctcgagcacgatgtaaaaaaaatcgtattctcctcgacggcggccgtctacggagagccttaatcggtgccgattacagaagacatgccgacaatgccgacaagcacctacggggaaacgaaactgatcatggaaaagctcatgaagcggactgaagaagcccatgggatcagctttgtgtctctcaggtacttcaatgttgcaggggcaagggagacgggagaaatcggagaagaccaccgtccggaaacacacctagtccccctcatcctgcagaccgctctcggccaaagaccgcatataacgattttcggcgatgactatgatacgcccgacggcacatgcatccgcgactatgttcatgttgaagacctcattgacgctcatctgtcggcattagactatttaagaaaaggcggcaaaagcgatatattcaatctcggcagcagcgaaggattttcggtgaaagaaatgattgatgcggccagaaaggcaaccgggaaagacattaccgccgagatcggcaagcgcagagccggcgacccgagcatcctgattgccggctctcacaaggcaaagcaagttctgggctggaggccttcgcgcacatctgtagcaaagattattgaagatgcatggaagtggcattcctcgcatccaaacggttacaggaaggaagtgtcaacatgattgaacaagacatagccggactcattcaaaaagcgcttgaagcagggttaatcgaaccggctgacgtgaactacgcgcgcaaccaagtgatgaatctgctgggcttggaatcgtttcctgaggaagccactgctgcttccggcgactccatcccagaccttttggaaaaactcgcagcctatgcagtcgaacacggcgtgataaccgacgatctagacgcgaaagacatgctggcggcaaatgtgatgaactgctttgttgcaagaccttctgtcatcaatgcagtgttccagcagaaatacgaacaatcgccgctggcagccaccgaatatttttatcagctcagcaaaaacagcaactatatccagacgaagcgaattgaaaaaaatatttcgtatcagatggatacgccttacggcacaatggatattacgatcaatttgtcaaagccggaaaaagaccctgaacaaatcaaacgggaacgcgccgctgcaaaacaatcgcgcagctatccgatgtgcctgctgtgcaaagaaaacgaggggtatgcgggacgaatcgggtatcctgcccgggcaaaccacaggattattaaagtcccgctcgccggagaaaactggtattttcaatattctccatatgcttactataacgaacacagcattttattttctgagcagcatcggccgatgaaaattgataagcttgcctttcacaggctgcttgcttttactgagctgtttccgcattattttatcggatcgaatgccgatttgccgatcgtcggcgggtctattttaagccatgaccattatcaggccggacgatatgagtttgcgatgacgcgcgcggaaggcgcgttctcctttcaaatcaaacagcatccggccatcgaagcttccgttttaaaatggccgatgtccgtcatccgcttgaaaggaactgcgatcaacagccttgttgaagcggcggaccatatttttcagacttggaaaaactactcggatcaacaagcggatatctcggcttttacagatggcacgccacataacacgattacgcctatcgcaagaaacgtgagcggcgtttatgaaatcgaccttgtgctcagaaacaaccggacatctgccgagcacccatacggcatattccatccgcatgctgacgttcaccatattaagaaagagaatatcggcttaatcgaagtgatgggcctggccgtccttcctccccgcttaaagaccgaattggcggcagtgaaagaattcctgctcggtcagtcagatgccgttgaagcgcatcaccgggaatgggccgaacagctcaaaaccgaatacggagagatgtccgaaccggagcaggctgaatcaattgtacgaaaagaacttggcaagaaatttgtcaaagcccttgaggacgccggagtattcaaagaccgcgaagctttcatgcgctttatccgcacagtcaatcatcaggggtaaggcttcaccggtgttaaaataggcgaaaaaataagcttattttagcaccggatcaaacagctccgccagcagcaatgaaacggctccgtaaagcgtcgcttcatcgccgagcttcgttatcgtcacttctgtctgcctcgcttcggctgttaaagctttctgctgtatcgtttctcgtatcgccggcaatatgaacctcccgcccttcatcactcctcctcccagcacgattttgcccggattgacaagatgaatgaaattggtcagcccgattccgatgatcacaccggtttcctgaaaaagttcgatacatgtttggcagccgttctcggccatttcaaacaaatctttggctgtcaggctgtcagtgctttctttcaaccgctttttcccccgttcggcaattgcttttccgctcacaatcgtctgcaggcagccgcggttgccgcactcgcacttttctccattgatatcaatgatcatatggcccagttcacccgcgatcccttcagctccatggtacagttttccgttgatgacgatccccgcaccgacgccgcggccgatattcacggcagccatgctccctgcgtcatcgcggccgccgaaccacgattcgccaagcgccatcgcccgggcatcgttttcaactcttacggttaagttgaattcttgttccagcacatctttgatggggatattggttaagtttaaaatcggtgcgatgcgcgacattcccgtttcagcatcgaccacaccgtgcattgcaatgccgatcccgatgatcttttcttgctcgacatcggcacgtcccaaaatggcatagacactttcttttaaaacttccatgaacctctcgtttgtcagcggttttttcagcaggctggacgtccgctgcaaaatccctccggctaaatcggttaagacgcactccaccgtctcaggcccggcatcaatgccaatgacataataggcacccgtgttgatgtggagcatggtcggctttcttccgccgctcgaatgaccgagcgtgctttctttaacgagtccttgtccgatgagctctttgacgatgcttgagaccgtgggaggggtgatctttgtttccttggcgatctcagctctcgaaatcggctctgatgttctgattttattaagaatgatcgatttgttcaccgatttcattaattgaaatgtaccgcgctgcatgtgaaatcctccatttacaccatatcgtaggttttattgtaccatggttaattaattaaattaacaaacgaaaacaagataggtgtttccgaaggctttgtacaacattgccacagaaatggtcaaaacataaagggcacctgctccctttacttttttgcttcaggggggctttcaaagcgcttctgcaaaacaaatggtttctaaatggaaaaatttttcgaaaaatttaaaatgaaagtgtttgcataatcaaaataatcgcgttatcatacttgtatacaagtatactcgtataactaggaaggtgagtgtatgagcgaatctaaaggccttttatatccggagaagtggctttctagagcttcaactggtgttcgcgtcgcatgcgagctgagaatgcgcattatttccggtttgattgaaagcggtaccattttatctgaaaataaattggctgcggaattctcggtgagccggtctcccatccgcgaggctttaaaaatactggcatcggaaaaaatcatccgtttggaacggatgggggccgttgtcatcggtttaaccgaaaaagaaataggagaaatttatgatgtgcgcctggtgatggaaacattcgtattcgaacggcttggacaggccaatgtcgacgaactggtaacagacctcagcaaaatattggagatgatgaaagtctccatcaaatacaaagatgccgacgagttctcatttcaagacgtcttatttcacgaaacgattgtccgctccatcaatcattcttacattttgatgatatggaacaatctcaaacctgtgatggaaagctttattcttttatccatgcgggcccgcttaaaagaaaaatacgaagactttgaacgaattctcgataaccatgaactttatattcaagcgatcaaaacgaaagacagggatctgatgcttaaatccctacatcaaaatttcgatgacgtacaaggtaaagttgaagatctatggctgtcgcaacaaatgctggcgaaaggagccgaacaacaaaatgactagttatatgttaggcatagatatcggtacgacaagcacgaaagcggttttattcagtgaaaaaggggacgtgatccaaaaggaaagcatcggctacccgcttcacacgccggacatctcgaccgctgaacaaaacccggatgagatctttcaggccgtcatccagtcaacggcgaaaatcatgcagcagcatcccgacaaacagccgtcattcatttcattcagcagtgcgatgcacagcgtgattgcgatggacgaaaacgacaagccgctcacctcctgcatcacttgggcagataacagaagcgaaggctgggctcataaaatcaaagaagaaatgaacgggcacaatatctacaaacggacgggaacgccgattcacccgatgacgccgctaagcaaaatcacgtggattgtgaacgaacatcctgaaaccgctgccaaagcgaaaaaatatatcggaatcaaagaatatattttcaaaaaactatttgatcaatatgtcgttgatcactcattagcttcggcgatgggaatgatgaatctcaaaaccttggcctgggacgaagaagcacttgcgattgccggcatcacgcccgaccacttatcaaagctcgttccgacaacagcaattttccataattgcaatccggaactggcggcgatgatgggaatcgatccgcaaacgccgtttgtcatcggcgcaagcgacggcgtgctgtccaacctcggcgtcaacgcgattaaaaaaggcgaaatcgccgtcaccatcgggacaagcggcgcgattcgcacgattatcgatgagccgcaaaccgatgaaaaaggcagaatcttttgctatgccttaactgaaaaccattgggtcatcggcgggccagtcaacaacggcgggatcgtccttcgctggatcagagatgaatttgcttcatcagaaatcgaaaccgcaaaacgcctcggcattgatccatatgatgtcttgaccaaaattgccgaacgcgtcagaccgggtgccgacggactgctgttccatccatacctcgctggcgaacgggcgccgctctggaatccggatgtgcgcggttcattcttcggcctcaccatgtcccataaaaaagaacacatgatccgcgcggcattggaaggggttatttacaatctgtacaccgtcttcctggcgttgacagaatgcatggacggtccagttgcccgaattcaggcgaccggaggcttcgcaaggtctgatgtgtggaggcaaatgatggccgatattttcgaatcggaagtcgtcgtgccggaaagctatgaaagctcttgtctcggagcctgcattttgggactgtacgcgacgggaaaaatcgattcgttcgatgtcgtctccgacatggtcggaagcacgcacagacacgcgccgaaagaagaatcggccaaagaatacagaaaattaatgccgatctttatcaacttatctcgagcactggaaaacgagtatacacaaattgcaaattatcaaagaagcttaaccagcaaaaaataggggaagaattggaggcgttatcatgccattattaatcgtagcaatcgggattgtcgcattattgcttttgattatggggttaaaactgaatacgtttgtttccttgattatcgtatcgttcggtgttgcattggcacttggaatgccgtttgacgacatcgtcaaaacgattgaacaaggccttggcggaacgctcggccatatcgcattgatcttcgggctcggcgccatgctgggcaagctgatcgcggattcagggggcgctcagcgcattgcgatgaccctcgtcaacaaattcggggagaaaaacatccaatgggcggtcgtcatcgcctcctttatcatcggggttgctttattcttcgaagtcggattggttttattgattccaattgtattcgcaatttcaagagaattgaagatttctattttatacctcggaattccgatgacggcggccttatccgtcacacacggcttcctgcctccgcatccgggaccgacggctatcgcgggagaactcggcgccaatatcggggaagtgctgctctacggtatcattgttgcaattccaaccgttcttttggccggacctttatttacgaaactggcgaaaaaaatcgtaccgcaatcatttgagaaaatgggcagcatcgcttcactcggtgaacagaaaacgttcaagcttgaagagacgccagcctttggcatcagcgtcttcacagctatgcttccagtcattatcatgtcgatttcgactattattactctcattcaagaaacaatgggacttgcagacaacagcttcctggcagcgattcgtttaatcgggaatgcctcgacttcgatggtcatctccctgttgttcgcgatttatacgatgggtatcgccagaaagatcccgatcaaacaagtgatggattcctgttcaaccgccattactcaaatcggaatgatgctcttgatcatcgggggcggcggcgcattcaaacaagtcttgatcaacggcggagtaggcgactatgtagctgaattattcaaaggaacggccatgtcgccgatcttgctcgcctgggtcatcgccgcgattctgcgaatctctttaggttccgcgacagttgctgcattaagcacgaccggactcgttcttccgatgctcggacaaagcgatgtcaatcttgcactggttgtgcttgcaacaggggcaggaagtgtaatcgcttcccatgtcaacgacgcgggcttctggatgttcaaagagtatttcggcctgagcatgaaagaaacattcgccacctggacactgcttgaaacaattatcgcggtggccggattaggatttactttattgttaagtctatttgtataaaaaagttttagtgaaggagcaggtactacatgtgcaatacaatcggtgtcataggtttgggggtcatggggagcaatatcgccctgaacatggcaagcaaaggcgaacaagtcgccgtctataactacacaagggatttaaccgatcaactcgtccaaaaaacgggaggccaaacagtcaagccatactatgagcttgaagatttcgtacagtctttagaaaagccgcgaaaaatctttcttatggtcacagcaggcaaaccggtcgattctgtcatcgactcgctcgtccctctgcttgaagaaggggacgtcatcatggacggcggcaactcccactatgaagatacagaacgacgatatgacagtttgaaagtgaaaggaatcggctacttgggaatcggcatttccggcggcgaaatcggcgctttaaaaggcccatccattatgccaggcggagaccgggacgtctacgaaaaagccgctccgattctcacaaaaatcgccgcccaagtggatggagatccatgctgtgtctacatcggtccgaaaggcgcgggtcattttgtcaaaatggtgcacaacggcatcgaatacgcagacatgcagctcatcgccgaagcatatacgtttttaagagaaaagcttcttttgccgatagatgaaatcgctgacattttcgacacgtggaatcaaggagagctgaacagctatttaatcgaaatcacggcggagatcctgcggaaaaaggatgagaagacgggcgctccactcatcgacgtcatcctcgacaaaaccggccaaaaaggcacgggcaaatggacgagcctgcaggccgtcgacaacggcattccatcatcgattatcacggaatccctgtttgcccgttacctgtcatcattaaaagacgaacggacagctgcggaaaaagtattggccggacctgcaacagaagaacggcgcctggatcaaaacgtgtggatcgaccgcgtcagacaggcattatatatgggcaaaatctgcgcctatgcacaaggcttcgctcaatacaaaatgacatctgacctgaacggatggaacctgccgttaaaggacatcgccctcatcttccgcggcggctgcatcatccgcgcacaatttttaaatctcatcagcgaggcgttcgacaaacagccggacctgtccaacctgctggtcgcacctgacttcgctgaaaaactaaaagaataccagtccggcttgcggaaggtcgtctgcgaaggcatcagctcaggcatctcattcccgtgcctaagcactgccctttcctattacgacggctaccgcacaggccgctcaaacgcaaacctcctgcaggcccagcgcgattatttcggcgctcacacgtatgagcggacggatatggaaggcgtgtttcatacggactggtattaaaaactgcaccccggatctcggggtgcattcttatttcactcaaatggattttcatactttgttcaacatttcacaaacttatatttcaaattcgtgctatgataaattcaacaacagaaaaggaggattgatgccaaaataaaccagatatccgcttcagggataaaaatttttaacctaacttgtgaaatgtttcacaaactttaccgacttcattcatccctggacatcctgttgtaatcaaattcctattcattcactggagggtttacaatggcaatcgaagaaaagaacatgaaacaaaagcaaaatgcctcaaacatgattgatcagctagtcgaaaaaggcctaaaggcattggaagaattccgcagctttgatcaggagcagattgatgagatcgtcaaacagatggcgcttgccggccttgatcagcacatgcctctcgccaaacttgccgtcgaagaaacgaagcgcggcgtttatgaagataaaatcattaaaaacatgtttgccacagagtatgtctaccatcatatcaaatacgataaaacagtgggcatcatcaatgaaaacgaacacgacggagtcattgaaatcgcggagcctgtcggtgtcatcgccggcgtgacgccggtgaccaaccctacttccaccaccatgttcaagtccctgatatcaattaaaacaagaaatccaatcgtgtttgctttccatccatccgcccaaaaatgcagccgcgaagcggcgagaatccttcgggacgcagccgtcaaagcaggagcacccgacaactgcatccaatggatcgagacgccttctctggatgcaacgcaagccctaatgacccacccgaacgtttccctgatcctcgcaacaggaggcgcaggcatggtgaaatccgcttacagctccggaaaaccggcccttggcgtcggacctggaaacgttccgtgctacatcgagaagtctgccaacctgaagcaagccgtcaatgatctgatcttatccaaaacatttgacaacggcatgatttgcgcatcagagcaggccgtcatcatagacaaaggcatctactcagacgtcaaagccgaaatgacaagaaacaactgctatttcttaaataaaaccgaaaaatcaaaggtcgaaaaattggtcatcaatgaaaatacttgcgcggtaaacgctgatatcgtcggcatgccggcattcaaaattgctgaaatggccggtatcaaagtgccgcaagatacaaaaatcctcatcgccgaattagaagatgtaggtccggatgacccgctgtccagagaaaaactgagccctgttttagcgtgctacaaagtcagcgggcttgaagaaggattaaaacgcgccgaagagatgctggcgttcgggggaaccggccactcggcggtgattcatacgaacgatcaagaagccgttaaagaattcggcttaaggatgaaggccggccggatcattgtcaatgcaccgtcgtcacaaggagcgatcggcgacatttacaacgcctatatgccttctttaacgctcggctgcggcacatatggcgggaactccgtctcgtcaaacgtaggggccgttcatttaatcaacacgaaaaaagtggcgaaaaggaatgtcaatatgcagtggtttaaagtgcctccaaaaatctattttgaaaaacacgcaacccaatatttagcgaaaatgcctgacatctcaaaagcgtttattgtgactgatccgggaatggtgaaactcggatatgtagaccgcgcccttcactacttaagaaggcgcccggattacgttcattgcgaaattttttctgatgtcgagcctgatccttcaatcgaaacggtgatgaacggcgtcgacatgatggccaaattccagccggatgtcatcatcgccctcggcggaggttcggcaatggatgccgcaaaaggaatgtggatgttctacgagcaccctgatgctgaattctttggcttaaagcaaaaatttctggacatccgcaagcgcatcgtcaaatacccgaaactgggaggaaaagcaaaattcgtcgcaatcccgacgacatcaggcacaggttctgaagtcacttcattctctgtcattacagacaaagaaacgaatacaaagtacccgctggccgattatgaattaacaccggatgtcgcgatcattgacccgcaatttgtcatgaccgtgccgaaacatatcacggccgacacaggaatggacgtattgacacacgcaattgaatcatacgtatcgtgcatggccaacgactatactgacggcttggccatgaaggccatccagctgatcttcgaatatctgccaagagcatacaaaaacggcagcgacgagctggcccgcgaaaaagtgcataatgcatcaacgattgccggaatggcattttccaatgccttcctcggcatcaaccacagcttagcccataagcttggcgccgagtttcagatcgctcatggacgggcaaacgccatccttctgccgcacgtgatccgctataatgcagcgaagccgaaaaagttcacggcatttcctaaatacagccacttcatagccgaccagcgctacgcggagattgccagaacgctcggcctgcctgcaaaaacaactgcagaaggtgttgaaagcctcatccaggagatcatctcgcttgccaaagagcttaaaattccgatgagcattaaacaaaacggcgtggatgccgccgcattcgaaagcaaagtagatctcatggccgagcgcgcctttgaagatcagtgcacgacagccaatcctaagctgccgctcgtttcagagctggctgagatttaccgttccgcgtataaaggagtttagccaaaaaagccgtcattccgacggctttagtttgttgacaaaatcccaaaacgacttttagttttgggattttgtcatcctttcagcgtgattgaaaacccttgcagtctaggaaggccgagcatcggagcgcagcgaatgttggaattcgtgagcaccgacgcgcaggcctgacaacgaatgcgaggatttgtcgacacgctgaagccgtcattccgacggcttttctttattttcaattaggcctctttattctcacttctctatcatttgtgccaatcatactatatgaaaatgaaactccaactcttttctttagctgaaatacttaacaaaaaaataaaggtctttccccttgacaaaaaatatttattatttgataatttgtatataattataataattatagagaaataaagtttacaattttatttctcttaaactacattcaggaggacgatattatgtctctaatcggaaaagaagtacaaccattcgcagcaaaagcttacaaaaacggtgagtttatcgatgttacacacgaagatctgaaaggccaatggagcattttctgcttctatccagcggatttctcatttgtttgcccgactgagcttgaagaccttcaaaaccactacgaagctctaaaagaactaggtgtcgaagtatactctgtttctacagatactcacttcgtacataaaggatggcatgacagctctgagaaaatcggcaaaatcacttacgcgatgatcggcgacccatctcaaacgatctcccgcaattttgaagtgctgaacgaagaagaaggtcttgctgaccgcggaacattcatcatcgatccggacggcgtcatccaagctgttgaaatcaacgcaggcggtatcggccgtgatgcgagcatcctgatcaacaaagtaaaagcggctcaatacgtacgccaaaacccaggcgaagtttgcccggctaaatgggaagaaggttctgaaacactgacaccaagccttgacctagtaggcaaaatctaaggagtgcattcaattggtacttgaagcaaatatcaaagcacaattaaaccaatacatgcagatgattgaaaatgacatcgtccttaaagtcagtgcaggcgatgacagtgtctctaaggatatgctggctcttgtagaagagctggcttccatgtcatcaaaaatcactgttgaaaaggcgcagctcgacagaacgccaagcttcagcgtcaatcgtgccgaagaagatacaggcgtgacattcgccggggttccgctcggtcacgaattcacatctttggtgctggcactcttgcaagtaagcggcagaccgccgaaagtcgatcaaaaaatcatcgatcaaatcaagaacatcagcggcgagtaccgcttcgaatcttatatcagcctcacatgccacaactgcccggatgttgtgcaggcattgaacatgatgagcgtgctcaacccgaacatctctcacacaatgatcgacggtgcggcatacaagtcagaagtcgaaagcaaaaacattatggctgtgccgaccgtatacttgaacggcgaatcctttggaagcggccgaatgacgcttgaagaaattcttgcgaagatgggcagcggcacagatgcgtctgagctttctgataaagaaccgttcgatgtactcgttgtcggaggcgggcctgccggcgccagcgcagcaatctatgcggcgcgcaaaggcatccgtacgggaatcgttgccgaacgcttcggcggccaagtccttgacacgatgagcatcgagaacttcatcagcgtgaagcgcaccgaagggcctaagcttgcggcaagccttgaagaacacgtgaaggattatgatatcgacgtcatgaacctgcaacgagcaaaaggcctcgagaaaaaagaccttttccatctagaactcgaaaacggcgctgttctgaagagcaaaaccgtcattctttcaactggcgcacgctggcgcaatatcggcgtacccggcgaacaagagttcaaaaacaaaggtgtcgcatactgccctcactgtgacggaccattgtttgaaggcaaagacgtcgccgtcatcggcggcggcaactccggcatcgaagcggcgattgaccttgcaggcatcgtcaaccatgtgactgttcttgagtttgcgccggagctgaaagcagacaaagttctgcaaaaacgtctctacagcctccccaacgtgactgtcgtgaaaaacgcccaaacaaaagaaatcacgggcgatgaaaacgtaaacggcattacttacgtagaccgtgaaacaggagaagaaaaacacgtcgagctccaaggcgtcttcgtccaaatcggtcttgtgccgaacacggaatggctgcctgaaaccgtcgaacgcaaccgcatcggcgaaatcgcagtcgacaaacgcggcgaaacaaccatccctggattgttcgctgccggcgactgcacagacagcccgtacaaccaaatcatcatttccatgggatccggagcaaacgctgctttaggcgcgtttgactacctgattcggaattaatctataaaaaacgctatgctgaagttttcagcatagcgtttttctgtattcccgcaaccacggctcattcgattttggcaatggaagcatccctcaagcagcgcacctcggcacggaggcgccctctttgtagtcataaccccttataatagaattcattttctcatcttctttaatttggtactataaatatagtagttttaatattagtcatcatgaatagaggttacttgaaatgagaaaagaacagtcttttatgaactcaactgctttctttatcatcatttgtatgttaggcgggatactttttcttttaacgaagtgacatgaactttagatctatattactgagaagtatacgtataagaagacattagtccacgatgtcatatcaacttatatcagccatctcagcttatcaggtttttccttcatgcagttgaacgtggaagaagcgaagtactttgaattggagacttaatcgcccaagcattacattcgagcattctttcaattgatgaacagcctcagttttgataagcgaaaggccggcgtcaatacaaccggccttatttctgcggcacctcttttaatgaaccaacccatacagttcctgcgctcactttataccactcatcttttccgtcattatcttttgaataggacatttcttttatgcgcagcacatcgccgctgcttctcaatcctagttcgaggtcctcctccagatcagatagccggtaatacacggtatgaatatgaggttcccattcaaatgcattcagctcatgttctaaaggttcgtatattttcaaagagaacgcttctttttcttcttgcttgtcgaaagaaccactgtaaaaatcaatcgcttctttataagcagccacaatttgtgaacggataaaatcaggctcatacaaccaaattttcaagtagaaatcttcattttcagctttcaattgcttatgccattcatgatagacatcgatcatcgcctccaaaagcaagcgtttataccataatggaggagtcactgtttgaagcccgtaaaaaggggatatccataatttaacgtaatctctatgatgatctcttaaatattccatattcaattgaatattgtctgatttccaccattctattcttcgtttcagtcttttccagcctcttatttttttctttgccgaaaaatacatattgacctcccttcgcgtaacaaaaacggcgcaagagaccgcccccttgcacctaacaacacgtcatttacttataataattataatcattaaatgtcgcgatcatatcgttttgcgtcccgctttttccgcgattcgtattaaagtaaagcgtcccgtcatcaaaatcgacagcctctatttcaaaaagcgtgtatgcactgctggtaattctgaaagataaatcgctgcgagtaaacaattccttcgaaaagtcctgaatcgggtttgttttttgctctttaatcatttcattgatatttaaagggtacgtcaatataatgctcacatttgaagcattgccattgctgtccggttttgtaagcggcacatacaatgtcccctggtaaaaggaaattccttgctgaatgaaatgcgaaacatccattgtctgatgattcacaacagctttcgaatagtttaatttaaacgttgcttcatagtcgaattttccggttgtatcattgaatgtcccaataaagaacctttttcccgatcttacgataaatttatccgtcccaaccgagtatgtgataccgccaatcgacaaattcgaaccttgataattcagcacatatgttttagccactttataagtatttttcgttgtatcgacgctgagcttcacgattttattggcatacttagtgccgtcagacatcggcgccacataaacgctgacgcttttatcgcccgcagatgctttgacagccaagtcattggcgtgccctaaatcatagctcgtagtattggtatccgaatttttaagaagtgcaacggttctattgcttgccgtaccgctcattttcacagagaataactgcgtcgtgtgattcgtgttattcaattttgcagcgtagatcacattgttattgcggtcgacgcacatcccctgcatcgccgtgaaataccccgacttagacatggaaacataatcggtatacgtattaaagtagcctgattgcgcatatgcagccgtccccgcaaagctgctgagagctaagataaccgctgctatgaaaacttttggttttttaaacaccatgccatccccccttaaatgatttccatattatatccttgaaggaatattgcgtcaatataagattgatgtccccctcctttctatgcaatatgccctcagaaagcttcctgtttgttaaaatttagattaatttatcataaatatggtactattattttaaaaaagagattcagaggctgaaacaatgaatgaacttgtgtttgaaaagagagaatttactcaagaccatgtgaatgttgtaaaagcaatgcatataaataactatccgattgtttatatcctttataacgagaaaaagaaaccgactgcatatattggacaaacggttcaagctgcacggcgtttgaaaaatcatatagatgatgaaaagcgaaagagtttgaatcgctttattttaatcggccatgagaaatttcatcagtctgcgacatacaatattgaataaatttaattaactattttatcgccgataaccgctaccagctgcaaaacgtaagccagaccaggtctagggaaatgcacaattactatcagaaacccttttataatgaaaatatctttcaagtcatttgggagaagctgagaaaagagaaaattgtgaacgattctctttaaaaccttaggaataaagacatttataagttatctccttataaagagctctcgcctcagcagcttgatattaaaaataagatccttgatttctgtaaagaacgtatacaaaaagaaggaaatcatgtcattgttattgaaggagatgccggcacaggtaaaagtgtcctgttaagctctctgtttaatacgattcaagatttggctaagagtgaagactcttttttgaaagaaacagataattacttgctggtaaatcacagcgaaatgctgaagacttataagagcatcgccaacagcttaccgaatttaaagaaaaagagtttcatgaagccgacaccatttattaatgagaagaccaagacgggagcaacagcggatatcgtattagtagatgaagctcacctgcttctgacaaaggaagattcctataaccatttccgctaccaaaaccagctgtatgaaatcattaagcgaagtaaaatcactgtggtgatctttgacccaaaacaagtcttaaagattaaaagttattggaacgaaagattgctcgaggaaatcattaatcagtatgatgcgaaaaccgtaaaactgacagaccaaatgagaatgaacgccaatccagaaacaatcaagtggattgacagctttgttgaaaagaaagttcttccctttccgactgaagactcctccttcgagcttaaaatatttgaagatgctgctgcgtttaaaacagctattgaacgcaaaaacagtgaagacggtctctcccggattgtctcgacctttgattatttacataaaaaagataaaaagacttacatcgttgatgaagaagggattaacatgccctggaacagcacccaagataaagtgacatgggcggaaaatccgaattctattaaagaagtcggctccatttataccgttcaagggtttgatttaaattacgtcggcgtcgttctcggcccttccgtaagctatgatgaagaaaaagacgaactggtaattgatacttccaaatacaaagatacaggggcattcgtgttacgtacagatttgtctccagaacagaatgaacaaattaaagaacaaatcatcctaaattcaataaatgtcctgatgaagcggggcatacaaggcctctatatttatgcgacagatcctaaattaaaaaagagactactcgagttagaaaggggaaaatggtcatgaacgatatccaaagcctgatcaacgcaatcaacgaattcagagatgaacgaaactggaggcaataccatacccaaaagacctcgccatctcaatttccatcgaagcagcagagctgctcgaagacttccaatggatcagcagtgaagaagcactcaaagcaaataaagaaacatccgtgaagaaatcgcagatattttgatctactctttcatgctgtgcaacgatcttggattggacgtgaaagagattgtggaagagaagattgtgaagaatgggaggaagtatccggttcatcataatggttaagaatctccttttaagtagagagagcttctttcacaattgaagaccgctctctctatctccatgatgcgttggttattatggcatcctgctttgttatcttaccgtaacccctccacttcatatgctttaacaccctttgattctttctgcaccgttcgctggctccctgttatttttgaaaaaatgacatttgtcatccgattttcatgacatcacttactaaaatccgcctccctcaacttatacaatgaaatgagtaaatcaggaggtggcctgtagccatgagcaatgttgtaagcttgacgaatgtgacaaagacattccgccaaaaaacggcggttgatcagatagatttttcaattaaaaaaggagaaattgtagccattctagggccaaacggagccgggaaaacaacaacgatttcaatgatattggggctgttaaaaccgacggctggcaacatcacattattcgattccatgccgcatgaaaaacgggtgcgtgaaaaaatcggcacgatgctccaggaagtcagcgtcatgcctggtttgcgtgcaggtgaaatcatcgaactcatccggagctactatccaaagcctctatcctttcaaaagcttagaacgttgacaggtttgacagacaaggatttaaaaacacaggcagaaaagttgtccggcgggcaaaagcggcgtctaggctttgccttggcacttgccggcgatccagaactgatgatctttgacgaacccacggtcggcatggatatcacttcaagaaaccgcttttggcaaacggttcaatcgctcgcagagcaaggaaaaacgatcattttttctacacactacttacaggaagcagatgatgccgcgcaacgaatcttgctgtttaaagacggcaagatagtagctgatggaacgccgctccaaataaaatcaagaatatcgaagcattcggtttcatttatagttgatccggaacagtcactcgagaagctgtatcagcacccagaaaccgaacagatttttcgtaaaaacaaccgggtttacatcgacacggccaatacggacaaaatactggaactcattttctcagaaaagatcggcgcttatgatattcaaattgagcgcggaaatctcgaagaggcatttcgccagctgacaagcaaaggagacgagtaaaatgaatgtatttcagatgcagtgcagaatggaaatcaaaagaatgcttcgaaaccgctattttgtcttttggtcattggccatgccgattgctttttattatatttttacaaatgtcgtcaatacgaatgctccagaccctgcggcatggaatgcgcattatttaatgtcgatgacaacattcagcgtcatgggctcttcgatcactcggcatccgcatggttcaagaacgcacccaaggctggtcgacgttcatacgcgtaacgcctcttcccgaccacatttattttatcgctcaaatgtcggggcaaagcgtcattcatattctttcgatcacagtaatcttcttagccggcgccttgatcaacggcgtttctttatccccattggaatggttcctgtgcggattgtgggccctgcttggctcgctcccgtttctggcgatcgggacattgatcgggatgatgaaaaaagtggatacagcagccggaatcagcaatgtgctgtatatggggctcgccgtatgcggagggatgtggatgccgcttgaaattatgccaaaaatgatgcagaatatcggccattggctgccgtcctatcattatggcagcggcgcctgggaaatcgctcgaggtcaaatgccaaactggaaaaatattctcttcctattagcctattcaatcgttattatgctactatctaaatatataagaagaaaacaagaagcggtgtgaacaagaatgaaaaaaaacttcagcatgtttccgaaacggtacggcttttttccttatatctttttaatctatttactgctgcccatttcttatttgacaaatcagacctcgggaatcaaacagctgatcggttttggactcgtgctgcttttcttggtgacgtaccgccagcttttttttattccgccgcaaaaaaaattatttacttattggctggccatccagctttcaatcattttaatctacactgtattttatgatatcaacttagtatttttaggctttttttcagcgaactttatcggctattaccgggaaaaaaagacgttccggtgcggccttgccagcctggttgttgtattggtcgccccttttatctatcatctgctgaaagatccatccctgcttaatcggctcttttattttctgccctttcttgtgattatgctcatttcaccatacggcatccgctccatgaaccgccgcatggaactggaacaaaagcttgatgaagcaaatcagcatattaaggaactggtcaagcgcgaggagcgtgtacgaattgcccgcgatctgcacgatacacttggccatactctttcactgctcacattaaaaagccagcttgtccagcgcatcatcgccagcgcccccgaacgggcgcgaaaagaagcaagagaaatggaaaccacatcaagagcagccttaaaacaagtccgggaactcgtgtctgatatgaaaacggcaactattgcagaagagctcatccacatccagcaaatcctgcgggctgcagacatcacattcgaatacatgggaggttccgatttttcaaatatccctcctgtcacacaaaacattgtcagcatgtgtatacgcgaagccgccacaaatatcgtcaaacacagccgcgccacccattgcaccatttccatctctcaaacagatgataaaataagcattaccatcaaagacgacggaatggggatggatcagcaaaaaacaccatttggtaacggcttgcgcggaatgaaggaaagacttgcattaatcgacggcgctctcgacgtttcaacccatgacggcacagttttaagcatcgccgttccaaatgtaaagaaagctgaaggaaaggaagcaatccaatgattcgtttatttattgccgaagaccaaagaatgctgttaagcgcgctgggatccttgcttgatcttgaagaagacatggaagtgatcggccaggcgacaaacggcgaagaagcgctcaccgccattctgaagctagaaccggacgtctgcctcatggatatcgaaatgccggtcaaaagcggactggaagtggccgaagagctcgcaaagcaaggcgcaaaaacgaaaatcatcatcctaacgacgtttgcgcgtcccggctacttcgaacgcgccgtcaaaagcaatgtccacggctacctgctcaaggacggggaaatcgacgatctcgcagacgccatccgaaaatgcacggaaggcaaaagaacctttagtccggaacttaccttcaacgctgtccgcgaaacaaacccgctcaccgaacgcgaacaggacatcttgcgactggcatatatcggaaagacgacaaaagaaatttctgaggagcttttcttgtcgtcagggaccgtccggaattatatttctgagattatgcagaagctggatgcgaaaaaccggatggaagcggcaaggattgcggaggggaaaggatggatttgagtggggtcttgagataagcagccatcatggtacaatggtattttaggagctttgacattggccttatagcttatcaactaactccttttaacattcacactcctgttttaagaggtatttccttagtcgattaattcaccagaatattcttttggttgttcaatgtcgctcttttctctgtatcactcagtgatataccttgtttgattggagtccaatactcatatgcatactcggtatcccattcaatccatttagaaactaccttactaaaatctcgtacctgtgttgacatatcaacggcttatcttatacatactcttaatatgattaagctctgtcttctcctctccttttcgaaatcaatacaaccattttcttcaactatttttattagtccttcttgaaacgattgacaatattcagcttcttcatttataagcttttgattaaaaatactattcagaaatttctctttcctatctgtaataatcaccgtataactaatcgaaaattatttcgctcggaccaaccagggtgccgtcatgatcccgggcgaaagacgaacggtccgtgacgtcaagcacggaccgaccgccaattgtactgaaacgccctgggcttcatccgacatcttacctccggtcaaattcgccgtttgctggctctatcaaaacaccaacgtacagcaaacagatgactcagcggcacaacaagcaacccatacaccgcggccactagtacagcccctatctcatcaggcctttggagcaaaacaacaacgcccacaaggccgaccccaacaagcatttctttggctacacggctccggagaatccgtacccatgactggcctgccacccgcagcggaaagtcacgcttcgcctgcagcagcgcggttatcaatgcactaatcgcagcagcgacagtgaaagcaataactaatgcaatcagcgcaagattcaacaaccatacaacgtacgctgcgaactgcgcgcggagaatcccctcttcggcaacatagacaactttcagttcaccgttgatatctcgatcacgcagtgccttcacgtcaaggccgtgtttccctaacaattcctgcgtagcagttacaccagtgaatacgatgttgctacctgagaccatggaagtcaaagcagaatcgttataagtatcgtagagcgagggcacgacaacaactaggacatcgtccgcaaagtgaagtctttcccctcctcctccttgggctaccggcaaccggaatccgtcgatcggccgcaagaacttgaacttaccgaactgctcatcggaaagctctttcctcgacaaaagctcggcctcttctcgaatcattttgacaagcccttttggaatgctatgataaggcacctttgtaacagcaggctgtggtgcatccatggtcaccatatcaagccaacgctggttcacgtaagagatggccgagtactctccaaaatcggctggcattggcatttcttgagtatatgtgtaggaaaaagctaccttatcaagcgattccgcatcctttaccagtttaccaatcagcggctccatgtggttcatctcgtcaacgtctgtcgcaaacacaatcgcaacttgatctgcgagtttcttccactgagccatttcagcagctatagctgaggaatgtttgtatgcggaccaagcaggtccagccgcagctaccaccaggaggaacgttaacgcctggatcacgatggcagctgaacgcaagcttttaacagcaggttgtctggtggcgatcatggtagcgctaggccatgcggaagctgacatgatcagcgtagccaacagggatacggtaataacagcgacctgcagactgaacagcgcattgaggaaggtaccgacatatatccagccatgaaacaaacctacgtagcaagacgcaaccagtgctacagccaccgccgaaaccagcagcgcccccccgaacccggccaggtcctgaacctgaatccgcgaggtcgggcacccgcccagaacccgaagagcacgcccacgcgctcttaacgacaaccagaacaacgcaagcgccgcaatcagcgcaaatgctgcaagaacagcggcagcaaatcctctttctcgcacaacgaattcaaggcttttaaaaatggacgcatccccgcgaccgaccttcacgccttcacttttcagcgtgtcctcaaactcgctcaagtgagccttttcaccggtcacgagatagaacccatcggggtaggaggtttcaagccggtccttaccgacaatcttgcctgcaccatcgccgccaaaccaagtaaattcgtcgggcagatctctatcgttaagtgctacgtagacctggccatcgccgtcgcttgcaaggtctggcgcaaccttgaccagcccaagattccagcgtgcatcgagcttctccagcttcgcaaacgcttcagtaatagaaagccccgattcgctgaaatcaaggtttaacctgctctcggcaccaatcgcctgaggaaagtctcgatcatataggtcggtgataatcgccgccagtagcgcaagcagagcaaacaacgcgcccgcgacagccactataatacgtttatacacaagctggacctccaagaactatttgaaaattgccatgctaagccccggcgaacacaaccggtatcgccggggactggcgtaattgcctggattaacagataatgttcccccttcatttcattcctcctcatttattcaactatttttgtcaatatttctgctcctcaactcgtttgtctctgcctccaatcaatcctccaagggctcatatgtaaagcctagccagcgcctcttgcttggcgtagttggtctgcatcaggttcatactgcttgacaaaaacggggagccagtcttgccgtaaacagcaggaaacgattacaccgagtgaattgtgtagaagttgagttagcgcttcaccaggtgcactgggaccccaaacccgtcacggcggctgagcaggtcggagattgcgtcatgctcggatcttgaaccatagctaaccatgaccagccctcggttctcgtcatcaggacacggctttcctacttcgaccgtaatgtcatcacccaaagctttaatctcctcgacgaggtcttgatgtctggaaagcgctgcattggcctctgttacgttcggcagctgatcgcacggcggatgagtgtctcttgacactgtgatccatccgtttaggaatgcaattgttccaactgcaagcaataatcctatgacgacaccgataatgatcttcgtggttgatttcatgagttacctcctaagttgccgggatcgttggtcgacaatggttttgacgaactgctggaaccgaccttatgccgagcaccacacgcgttgatcatctcagagtcgtgcgtagacacaataaccgtgcggccacgcgcagcgaagtccgcaaacagatcgataacctttcgccgattggttgagtcaagcgaggcggtcggctcatcgacaaacaagaatgcagcgtccttgtagatggcacgagccagtgcgagtcgctgcttctcgcccccactaaggtggctagccaactcgccttctcgaccctggagacccgtctgctcgagcacctgcgccaaccgctcttggtttcccgtgacacgccgcccaaggatgctcgcctgcatggtgacattgaatgccaccgactcctcatccataatgccgtaatcctgaagaatgaacgccgcatgatcacgccaaaaccgccgccgcgccgcagtaccgtagcttgtgacatcgtgtccgtctatcaagatgcgtccctgattaaccgggagcaatagcccgaggcagtgcaaaagtgtagtctttccacatccgcttggaccaacgagggctgtcatgacccctggcgggcactgaacggtctcaccatcaagcacggtccgcccaccaattgctactgaaatgccctgtgcttcaatcaacatctgtacctcccatcaaattctacgctataaaaagcggcactcatttattccattcctcctcatttacttaactatttttactcttcaagccgattaatcatcacccacctaccacattaataggggaacgtttttttctctcttgtagacagtgtcgtgacatactatctcttcttcgtcacaaacattaattccttttacaactagcaaatttcacttgttgtaccataagtaacctattgactgccggggcacaaagaatttgtttcttgtcaaatttgctgaataacggccggcatcaacactaaacctggaaaagtagaggattgcaccgcataaaataacttactgctaaggctaccaagataaaactacaaaattaaataaacctattgctttccaaaaaatgttagttgcattttatgttttttcctgcagatatgcactatcttttgtggagatgctttggcagtacaccgaaagcatctcctttttatatagatacattaatttaaaaattttaagaataaatactcggggcgcataaaatgccgcgcccctcaaagcggggtattacccctattgaattctcagagtttatgaaactttgcaatcaccggaataaaaaactatcaatcggtaagtgcttctggtaaattgctcccgcatcgacacggtagtgggcgaaaagacaagctaactcgaccggtaatccaaacctaaaatccggtatgtccttaccaaaataaaaacaatgaatatagatttaactctctcgaaaataacggcctgctgaaatctcgatttcatagatagggatgattgccgtcagcaggtgcaagaagtgtaaacaacaaagcccgcgtcatccactataatacgcttatgcaaagcgggatctcccagaacttttctgggtcttgccatgctagccccgttgacagcaaccgttttccctttgattagttggtgcgatagtagtaacgacccttaagaccaggtgagtttatggctccgacataggcattagagtagcggcccgcagccgtatcaatacttctattcgttttatccacttttccatcgatgagcttttgcactgtcgagccgtggacctttgtcgggtggttgtactctgaacggagcccggcgtttacgaatccatacctccatgtaccaccttccgatgggtactggtagtgataacccggattcacccatgcaaatgaaggcaccgtagcgcctcccaccaaagcgatggacattgtcaacacggcgagcgtcgctttaattgtccgagtcaaaggtttcctcttttttttctcatacaaatgatttttcattatttcattcctcctctttcattcgactaataaatttactctataagttagtttgtcaccgcccacataccgtgtcgatgcgggaagagttttttccctcgttggcggtgccatgatcatgactcctctttgtcaccagacatcaattttttcctccatgaccaaccctcgatccgaggtcatttggtcacgacttgtccacttcgacgaaatactgtcacctagcattttgatcacctcctcaataccctaatggctggcaagcaccacagtgtcctttactgcattcggttagtgaccgaatggtgcatgtcagaaacctcctaatctgttaaaagacctgctttttccagtttggattagtcagaaaatgaaagaagaagaacaaaagcaagtcaccaaattcaaatcttatctacctgaactggatgtattatgctgactcctgaagatcatttgatccggttagccagtgagaacgtggaccgtgtggctctatcattcagaaatactccgaatgtggaggaactcgtacaatccgcctatgctgtttaatttatggttatatatatcacgggtgtttcagcttccggaaaattcagacggctatccttaaatctgttcactggttgtaaaaggggagcgtcgtggttttcgcactatcagcgattttcggaaaagcaatctggatgtgttccaaaattgttcacgcaaaacagataaatcgttatgtaagcagataaaatggtaatctcagcgtttcgaaaaagaggtcaagcagatggtggaagaagtcaaagaagcggatgtcaaagatgaaggactgctctctcttttcccgaagacgatccgccgcaaaattcaatatcgtagaaatcggcttgcaaaagccaacgcggcattacaagaactggaagaacgcacacctgaagaaaaatagccaacgctacaaagatcaaatcaattttactgatgattagcgtcccatatcctgtctcaaaaagcctataattcacaagtcggtgttgaaggcatatgatttggcctagaaaagaataacagcagaagcttccggatgatttgggacagtgtcctggataatatagagacaaaacaggtgaaacgccaaacaactactgcggatgccaaacactatagtcctgaaaacatcctgccaaagaaacaaatcaaacaagatacctaaatgagagcaaataaacgaagaatccatatgacaaaagcagtttttatttgggtccggggaccctaacaccaactctctttaactcaaattaactaattttataataattgtaaaacaaaactgattcaagaggtttcctgattttttaaaaattttggtcaaaatgtattagatttgctaatgtataaaactcttagagggtatcagaatggatatttagattattttccctttttgttatataaaaatgaaaacttaaattcccatcttcctttaaatgcttaaccgattcagaaaattgtagactgttttaatgtattcttaatgtagcaaattgttggggattttctatttgcatttgagaggtgtaaaaaaagacaagcctaattgcttgtctcctgagtaattgtgtgtttctcctattcttaaggtaatatggataagttcaaattaaaattttccatcatttatgataaggctcccctcgattaatcctaaaagcccgataaacctgctcgagcaaaatcagcctcatcagctgatgcggaaatgtcatccgtgaaaacgacagcttctcatctgcgcgcttcaggacggcgtcgcttaagccgagcgagccgccgatgacgaaggttaccttgctctttccatatgtggcgagtctatccatattatcggctaattcttccgaacttttcatttttccttcgatcgccagggcgatgacgtgggcgtctgggctgattttggagagaattcgttcgccttctttgtctttgacgattttcatgtcctggtcgcttaggttttccggtgctttttcgtccggaagttcgatgatgtcgacttttgcgtatgccgaaagccgttttatgtattcatcgattccttgttttaaatatttttcttttagttttccgattgctacgattgatatattcacaggtcatccccactttaagaacaagttattcagatgcattatccacaattgtggataaaggttgtgtatttagtgtccgatcattcgttccccactatatatactgcaggcttatcacacaattcacaggttgtggataaactgtgtgtatgttcgatttttctgatttccggggccaattcttcctcatccacatacatgtcaatgaccgtttcaatatgctcttcgcaagacttcataaaagtccctccaatatctgtatcattgggctcttttataaaaaagctccttattcaatataccctatttatgcacatgttagtaggttttagcatgacttcacgcggttatccacaagcttttatattcctctggataactctgttctctccaaataaaaaacaccagccaatctcgctgatgctttaatcttgtttttatactgcttctcttttttcctgaacaactaaagaatgctgatttgtaatatactgcaaatatgaaacgttaagaatgaaagtccaaaacccgttaacctgcttttccgacagcccaataaacgcttttctaaccttaaatgcactatataaatttaccgtccaaaaaaggaggaatgagagctgcgggagaaagctgtgtccggggcgcagcgggagaagcaaaatgctgttgctgtatggcagcaggtcttcactttgaaatgtgattgaataaaaagtccaaaaaggctccaaaattgaaaagacgcttaacagcagcgtcactttaatggcgacatacgggagcttaatttggcatcgttctaaattctttcttcttgagagaaaccaatacgggatgtatatgccggacgttatgatcgttaataacaccgcatataagggttttattttcggaaattcctctaattccttactcatgctgaaacactcttctttccttaaaactgttcttccaggtctttttatccttgtcatctatacttttccactttccatatcaaaatgtactatattgaatccaataaatcaaaatccattgaagtgttaaattgggattttcttaggtatatggattcttttttttgactagaataaaaaaactatatccttttgcccgttccttatttcgtgttcatctgcagaaattcgacaatcaataggacattattcgtcatatttttacctttgtaatatgcaatctgtcattacgcaacataaaggggttctatcgaatcattttgtctttttttcgttatttttcgtatctctcaactaggaataatgacacgctatgttccatgtggaacattggatatgaaaaaagatcaaagctttcacagctttgatcttacagtctcttgctcatatgcaaatctgtcgtctcgaaattcattttttcatatagtcgcttcgcttttttattatgggcgaatacatgcagggacagctttttgactcctaattgctttgcctcctcttctaagacggctaaagcctgctggccgattccctggccgcggtacgcttcataaagcccgaaatcgtaaataaacgcttccttttgagggtggtgcggatcagcgtagatccaaacccagcctgcggcgttcccgctgtcgttcatgattgaccatagataatggttgatcgtttcaatgccgtttggcaaaagggccgcaaactgctcttctgctttctccatcgcttccgccactgtccatgtgcccgcttttactttctccatggcgtaatgctggatggaataggtctggtatatcttaaagtcctcttccgtcattggcgtcaaacggatttccggcttttttctcggtttgttcaagtcaattttaattttcgatttcaacatcaaattgtacttcacttccttgtttatagatcatgatgctttgctcagccattcgcttttcggctcggaaagtttattgattctgtgctgaatgtaaatgatattcaaaaggaaggcaaaaatcgatccattcgcaggttctttgcctgaaagcttgtttaatgaagcagtcaccaccagtgcgcagtatatcaaaacacctgcggacagaatcaaaatcacgcggtcgagcagcatataaaggctgtaatgcatgtcaggaaaagcgatttttgctgatattctaattggaatagaaaataaatgataaaatatgatagcttttaacgtggtgtagggaatatcatgataaggcagcaaatcgaagctttttttcctggatagaaaccagtatggtatgtaaacccccagtgtgatcagacatagcacaaaaacggacaagatacttctgctctttacattagacagcgttttcaacgcagcctgcacattgtcgttcatatcattcctccggacactcgttttccaaacaaatgaattgaatgaattttttcatagcagcggcacaccccctcaatatattcttttctcttgttttagacaatatgacttaggtaccaatgtgacaaaagaaccatttttgaagaggttgctgtcttcacgattagctgaaaaatgtgtgacaaccgtttttatgtcataagaatgacacaaaagcaagagcctgactggaaaatcaggctcttttgtctaacgctatatactttttcgaagagaaatccgccagttgatgcctgtgccaatatggtatgttttagcaaatgatccttggttgagggcaatgcccaagcggtctaatgaattgatataaacaaccggcttgcctacaggcatatcggcaaacgaccggccaaatgccaacgtttgctgatagacttttgtgtcttcatgcttgatgacgacttctactggatctccgtattgaacatcaagtgacttgaagagcgtccggctgatattcgtccaaaggtttccaaaccggacatctaaaatatcgatcgttccggttatccaatcattttcgatgtacgcttccatgaccggcagtttgacgatggaatctatagaaacttccggaccgatcctgtcgaagctgagagcgccggctgccagtattgccccggtgtaggcgtaaatgtcgcgtccatggaatgtatgtgattcgcctgattttggaagcctgttttgcgcttcatcaagatagcgcgcctcggcaattccattttgccggctgatgtgggtgagtgttccgttgtctggtgtgatgatatattgattggaagaggttctgactgcgacgctgcggcgttctgagccgacccctggatcgacgaccgacacgaagacagtgccttcaggccaataagaaacggactgcagcagccgataggaagcttcccaaatgtgaaaaacgggaatgttgtgcgtcaaatcaaaaatccgaattgaactgtcaaccgaataagccacaccgtacatcgcatttaccgccccgtcatcaaggccaaaatcagattgtaatacaagtgcatgctgactcatcctatctccctttccgccctgatctttaaatcctgcattaaatcggccatttgtcagaatattaaagtcatcatatcgtacgcaaaattgaaacgcaatatgatgctttgtccattttttacaaactataatttttgcagggcaaaaacttggaattcacacccaaaaattcgattattcactcagaaaaaatctcatttcactctccaaaaatcacattttttccttttgacgatcattcgttgggcgcttcataataaaaaaacagcccggccgtaccggccagactgtctttatcagcttcctaattgggatcgggtcagctttacttctgttgtcttttcttttccgccccgcaggtatttgatttttaccttgtcgccgacgtttttggtgtaaagctttttacgcagatcaacgatatcgtaaacacggtcaccgttaaattcgacgatgacatcgagctctttcagaccggctctgcctgcaggagataccggctgaacacccatcacaactacgcctgatgttacgtttttcggcagtttaagcgtttcctgccagtgatagcttgcgatatcgccaagtgatttcatctcaattccgagatacggccgtctcacttcaccgtacgtttccaaatcttcgataaccggaatggcaaggttggccggaatgctcagaccgatgccttcgacggctgattcagcgattttcatcgaattaatgccgatgacttttccatcaatattaaacagcccgcctccgctgttacccgggttaatggcagcatccgtctgcagtacttcggcgttccagtccggctgtccgtctccgttggaatcgaccggaacagcgcgttcggttcctgagatgattccttgtgtaacagatcctgaaaactgcaggccgagcgggtttccaatcgcgatgacaggctcgcctgtcttcactttatcagaatctccaaattcggcagctgcttttattttgttgctgttgacttgcaggacggccagatccatcagcttatcgctgccgatcagttttgccggaatccgtgttccgtcattcaggctgatttctatttgggacgccccttcaatgacatggtggtttgtcacaatgtgggatgtgttgccgtcctttttataaataacgcccgagcctgttcccgcttcgctgtcaccatcccatacacctgtcttttggatgttgataacgccgacaacagaatcagaaaccttagagaccacttgcgtgacttcattattcacgttgacggatacattgcggaccgtcccgccctgctgtgctccttggccgccgcgcgcttcgatgacttgcagattatacggcagccatccctgctgcgagagatacggcaaggcaaacactgttaaaagagcgccgatgacggcgccgaccaggcttgaaaacaaaaagcttctccaacttctcaccggcttttcccgaacgaatttttcctcatcatgattaaactccactatattcaaatcctttcaaggaacgatatatgtatatagtgtggatcatctgcctgcagattaatcattcaatcaggaaaatttacaccgctacgagaggcgtcggtttcttaggatcggtatcatataagtcaaacgtttctcctgccgcaaatcctttggcagccagcgtttgctgcacagacattctcgccagctctttcatgttgttgtcctggcttaaatgagccaaataaattctcgatgtctcatcgccgattacatcggtcattgcgagtgccgcgtcctcattggatacgtgtccgacgtcgcttagaatccggcgcttgatgttccacggatagcggcccatttgcagcatgccgacatcatgattgctttcaaaaacaaaagcgtttgccgagcggatgatgcctttcattctgtcgctgacatagcccgtatccgtaatcaaagcgagctttcggccattgtaatgaaaaacgtaaaacatcggctctgcggcatcatgggataccccgaacgattcgacatcaagggagccgaatgacttgacggtttccattggaaaaacgaacttttggccgttatccattttgccgatatgcccttccatcgccttccacgttttttcattggcgtaaacgggcagctcatattttcttgccagcacgccaagcccttttatatggtcactgtgctcatgtgtaacaaagatgccgtcgagctgatcaagctttcgatcaatttgcgccatcagcccttccatcgccttcccgctaagtcctgcgtcaactaaaaaagcgtggtcatcggtttccaaatataaagcattaccggtactcccgctcgcaagtacgctaaattgcaggctcatggtttctcactccattatgatttttcctttttctcttgtgattgaagaagcgctccgtcccgtgcatccacgataaattcttcgtgaatggttttatcgtccgttttgcgctccacttcgatccgccaaacgggcacgaaaatttgagcgcttgccagcggatactgcgtgaaatagccaagctcggctgatttaattttgctgtacttcttcaaataatccgggtagtataaagcttcaaccgcgccgactgcagagatcagattttccgttttgacttctttaatatcctgcagcattgactgcttataagacacgacttcgtttttattattcaggtacagaacgacttcgcccatctcgttgttatcatcattttgccggtcctgaaaaatgtaattcccattataggtttggaagaaaacgatctgttttccggacttatcgaccttccaaagcttgtacttattgccgtcgataatctcttcattcacgatttcccttgcttttgtcttcatatccgttttcggaagcgcaatgggtgtttcaaactccatttctatttctgtcaaagcgttctcttttgcggtattcattaacgccttcggcttttgcccttttaacgatttaatctcgctttgcttaaagactcgcttttgtgcagagattgaggagccttttgacgtctctttagacaaattgccgtatgaaatatggtctgctttcatatcctcctgcagcgttgatttttctaaaatcggaaactgattgttgctgcgcttattaaagtattgaaaggccaaaaagatatcaaggatgaggaagacgataatgaagattgtttttgttctattccactccattttctatgccctccttcaccgctgaatccttctttgataccggctttaccgtaccgtttattttaatgcaccatgtcggcacaagtttgacaagagggtcttgttcctctgatactgagaccatttcataggcggggaaaatttgctcaatcttatcaaagtcatactcttcattgtcttgcaggaactgaatcaattcttctccgctcatgatttctttatcctttttgctgaccggatttgcgtttgcgcccaagacatatgtcgggtgtttatagtccaatatgtcgttgtttgcccagcgaagttcaatcgatgtcgttccgaaaggctggttttggctgttaacgaccggcagctgatccataaacagattaaagttgatctgctgattttcattcaaaccgaaaaattgataatcatccgtccagcttcccgtgtcgtttaaatatttgaagcttttattgatcagctctccattttgataagaagtactcggttccaggttgcggtgctggaacttaatctgtctgttgttcgagtagatctccaaaaggcttgttccatccgtatataccggtctgtttaagttggtttcctgccgcacggtttgcggatcatcaaataaagcttttttaaaacgcgtcgggctgatcgtttctgtaaaatactctttttcagacagcttcagccgattaaccggaagcaagacatctctgcgcgaattgattgcaaaatcctcataaagaggcatctgcgacttttctttttcaatgtctgaaaggatgttgcggtaatttgccgattcaatcaccgcttcaacaaccgtctctttgctgaaggatacaaaatagatcttcttcatgccccgtccttcattgaaaggaagaacgattctgtcaaaagagttgtattcataagaattggcggaccatttgaaaagcggctgcagcacatcgatcggaatgttgtcgctgaagacgagatccaatttggagtctttatttttagcgtatagccagtttttgaactgctgcctgtcaaatttgtccgagatatcctttaacgatttgacttcccatcgtcccatgtcatcccagagctgagaatagagcgtcgtgtcattcagcaaataatgctgtccattctcatgaatgaacatttgctgcggtttgacggcttcatttaacaactttgtctggtttgtaatcggctgtttgtcgctgacctgagcctgtgagtcttcaactttttcgtaattcccctgaaatccccaaatattaaaagtaaaaagaagactgatcaaaaccaaaagggacagtattatcgttttaattgtttcacgcttcatcccaatcatcctcttgttcttctttatacggcagggtaaatgtgatcgttgttccttttccttcgatgctgtcggcccagatgtcgccgctatgggcttgtaccatttcttttgcgatcgcaagaccgagtcccgtaccgccgagtcttcttgttctggctttatctacacggtagaaccgctcgaagatcttctccacgtcttttctcggaatgccgacaccttcgtctttgacactgacataaagaagctcttcttcttcatttacatcaacagagaacgtgatatggcctccttcaggggaatatttcaatgcatttgaaatgatattatccagcacttgcgtaatcttgtccggatcgatttcaacatacaattctctatccggcagattgctgataaactcaacatgctgctctttcgtcatttcaaagcgttcaataatcaatgagaagaaacggataaaatgaatccattctttattgaattgataatctttgctatcaaactttgaaagctgcagcaggtcgttgacaagcctgatcatgcgctctgtttcattctgtgtcacattcaagaagcgcggcgcaatgtttggatcctgccatgccccttccgcaagcgcttctaggtagcttcgcatcgttgtgagcggcgttctgagctcgtgggagacatttgcaacaaactctctccgctcttgatcgatctgctcttgttctgtgacatcgtaaatgaccgcaatcaatccgtcgatctttccgtgttctttttggatgaccgagaaattgacgcggagcacagacgtccgttcttcctgttcaatttcaagaagcagggaatcctgctgttcaaccaaatcttcaaacgtgtattcgtcttcaaggccgagcagcgaagtgatcggcatttcaagagccgtttcacgtgaaacatttagaagctccagcgccggcgtattaagcaaaataatcgcgccatttcggttagtcgcgataactccgtctgtcatatacgcaataacagaagatagtttttttcgttcgccttctgtcatggactgagcttctttcagctctcttgttaaataattaaacgttgtggccagctggccgatttcgtcgtttccgtacttcctgacttttcttgagaaatttcctttcgccagttcaatggcctgttttctcatatctgacagcggatgtgtaatcgttcgcgcgacaaaaatcccgagaaaagcagtgattccaagcgcaataaaagttccagacgctaaaatggtgttgatcgtccggatttgattgtagacattatccatcgatgccacgacgtaaatggccccgattgtctcttgattcgattttttaatcggtgtgaccgaaatccgcactttgctgtcccgctccgggtcgaaaaatttattttcgtatggaatgccgacaagcagcgtccttttgataatgccctctgttgtctttttccccgccacctcccggttataaggattggaggtcgcgatgacttcatagcttttatcaatcagactgacttcgagaatttcgccttctttgctgaaatcatttagaatccgctctgcatcttccttcaaggtagacgaggaagatgtgcttctatccttcgtcatttcctgttccagataatacgataggttgttcacccgctgatcaagagagtcattatatgatttaagaagtgacttctccatctcattgacaaagtagacgccgataatctgcatggcgacgataatcagcagaacgtatattaaggtaaacttaaaatgaatcgagcgaaaaaaacttactttattcatttgtgtattagtcctgttccggatttctcaaatagtagccgacaccgcgccttgtaacgatccagcttgggtgactcggattatcctcgattttttcgcgaaggcgtctaaccgtaacgtcaactgtccggacatccccaaagtagtcgtatccccacacggtttgcagaagatgttcacgcgtcatgacttgcccgatatgttttgcaaggtaatgcagcagttcgaattcccgatgtgtcagctcgattgtctcgtcgcgttttgaaacgacataggcatccggaaaaatgacgagcgatccgatttgaatttcgtttgaagacgattcttcttcggcaggagccgctgtgttctgtcttctcaggttcgctttgacacgcgccagcagttcgcgggtgctgaacggttttgtcacataatcgtcagcgcccagttcaaggccgatgactttatcgatttccgaatcctttgctgtcagcataatgatgggcatatcatattttttgcggacttcacggcacacttccacaccgtctttattcggaagcatgatgtcgagcagaatcatatcagggttgagatcctcaaccatctgaagcgcttcattgccgtcgtatgcgcaatggacttcatagccctcttttttcagattaaactctaaaatatcagcaatcggcttttcatcatctacaactagtatctttttttccattattcattcctcctggttcagagtttggatacagccagcggatggctgtctatgttttatatcaaagtacactgcatgtcatcattaaaaaaacactttctagaaatcgaaatagatttcttatacattataacgtttatgaagcaaaagttaaaaaaatagttcaaaggaaaacgtttggaaattaaatccacgctttatttttccgcttttatcacaacaattaaatttttgtgactttttttactgaaaaatgaaacattttatgcttcaaagccgtctatatagtaacgtcttcttcttcggccgggttaccggcctccctttttttctccttttcattccttcagcatttttatttcattgatttcagctaaaagaaaacgcatctgcttaaaaacagacgcgctttttagagtggctcgggacggaatcgaaccgccgacacacggattttcagtccgttgctctaccaactgagctaccgagccgggtatgtatgtaactttttataaaatggcggtccggacgggactcgaacccgcgacctcctgcgtgacaggcaggcattctaaccaactgaactaccggaccttgcatgattacagtacctgctgcggagaagaatcgtggtctcctccggagcaagcggggatttagcaataacgctaaagtaaatcaatgacccgtacgggattcgaacccgtgttaccgccgtgaaagggcggtgtcttaaccacttgaccaacgggccagggaaatggtgagccatgaaggactcgaaccttcgaccctctgattaaaagtcagatgctctaccaactgagctaatggctcgtctcgttgttttcgcaacaacgagatttatattatcatagaacgaacagaagtggcaatatatttttttatttttttctattattttttcccttcgtgatgatactccgccccttcgcggttcagccagtgcatgattccattcggatggaatacagacaacagccggtcagcttcatgaagcggcacccacttggcttcaacaatgttctcgtcaaacgtgatggcatccggacggtcggtgatccgtgctctaaagacgatgaaatatacatgctcgctgctgatcaccgcttcatttacggctaaaatatcaagaggctgaattccatagccagtttcttccttcatttctctcgccgcggcttccgtcagcgattctccagcttccaccttgccgcccggcaatgtccatgattgatttttcttgtttttcaccatcagaatgttgttctcttccgcgaatgaatatacaacatcgacacgttccatccgtttgccctccttgtcattgaaaaacaaagcccctgcggactgcagaggctcttctagaatttagttcggacgataaacgcttctcaccacatttgtttgagagcggtcaggaccgactgagaaaatggaaagcggaatgcctgtcagctgagaaactcgctcaaggtaatggcgggcattttcaggcaggtcgctcaagcttttcgcgcccgtgatatcttcggtccaacccggcatttcttcatagacaggctcacattcagcgagcgcttttaagcttgccgggaactcttccaggatctcgccgcggtatttgtaagcgacacagattttcaatgtttcaataccggtcaatacgtcaattgaatttaatgaaaggtcggtaattccgctgacgcggcgggcatggcggacaaccacgctgtcaaaccagccgacgcggcgcggccgacctgtagttgttccgtattcgcggccgacctcacggatttggtctccgatctcattgttcagctctgttgggaacggaccgtctccgacacgcgttgtgtaagctttcgacacaccaacgacgtgctggatttttgtcggtcctacacctgagccgatcgtcacgccgccggcgacagggtttgaagacgtgacaaacggatatgtcccttggtcgatatcaagcataactccttgcgccccttcgaataagacgcggcggccgtcatcaagtgcgtcgtttaagacgacggacgtatcgcagacatattgtttgatctgctggccgtactcatagtattcgtctaaaatgtcttctattttaaatccttccgcatcatacattttttctagcagacggtttttttcttccaaattgcgggcgagcttttcttcgaaaacgtccctgttcaacagatcggcgatccggattccgacgcgagcggctttatccatataagccgggccgattccttttttcgtcgtgccgattttattggcccctttccgctcttcttcgaccgcatcaagctttaagtgatacggcagaatgacatgggccctgttggagattctcaagttgtccgtgctgacgttccgctcatgaagataagccagctccgttaccaatgctttcggatcaacaaccattccgttgccgatcacacacgttttatccttataaaaaataccggatggaatcaaatgcagtttgtacgttaccccgttgaatttaatcgtatgtcctgcgttatttccgccttggtaccgtgcgattacctctgcattttcggaaaggaaatcggtgattttgccttttccttcgtcaccccactgcgtacctacaacaactactgaagacatatccgtgcacctccgttaaccttttcaaacgatatcaatatcaaacacattcagtttatcagtgtcatcccgtaaagtcaattgtaaatccgaacattaattttaacgttgaacatttttgttcgttattataaagcgaatttcatatattttctttttaatagacagtctgtaagtcaaatcttaaaaaaaccgtttttcttggacaaagatacataaaaaaccgacaacgcaaatattcaataagtaaggagggagatgccgatggagacggtattaatttttgcatcagttttatcgccgatcattttggctttggtcgaattggtgaagaagacggtcaaaatgccgaaaaatttgattccgctcgtttcactcttgataggtttgctgatcggtgccgcagcatatccttttacagaccttgaactggtgctccgtttatggtcaggaggactggccggattaacagcgacgggtttatttgaaatcggtaaaaaccgcaatgcaagaaaaaagaaaaatccctgagaacatgtctcagggatttatgcaccaggcgcaacacccgcgtcatcaaaccggcgttccaggttgacgaacttattatattcttttacaaaagcgagtgagacggtcccgaccgggccgttcctttgttttgcaataatgatttcaatgatgtttttattctcagattctttgtcatagtaatcatcacggtacaggaacgcaacgatatcggcgtcctgctcgatacttcccgattcccggatgtccgacatcatcggacgcttatcctggcgctgttcgacgccccgggaaagctgtgaaagggcgatgaccggaacttcaagctccctcgccagcgctttcagcgcacgggatatttccgatacttcctgctggcggttgtcacttgatctgccgcttccttggatcagctgcaggtagtcgatcaaaatcatgccgaggccgttctcctgctttaaacgtctgcacttggaacggatttcgctgacgcggattcccggtgtgtcatcgatgaaaattccgctgtttgataagcttcccatcgccattgtcagcttgccccaatcctcttccgtcaggtttccggtccggagattctgggcgttgatgttgccttccgcacagagcatccgcatgaccagctgctcggcgcccatctcaaggctgaagatcgcgacgctttcatcggttttcgtcgccacgttttgggcgatgtttaaggcaaaagcggttttgccgactgacggacgggcggctacgatgatcaaatcgtttctttgaaagcccgccgtcatcctgtcaagctcggtaaaacctgtcggaatcccggtgatgtccccttttctgttgtggagctgttcaatattatcgtaggtttgaacgagaacatctttaatattttgaaaggccccggagtttttgcgctgggcgacttccataatcgttttttctgcttcgcttaagaggtcttcgacttcatcctcccttgtatatccgtcttgggcaatcgtcgttgctgtacggatcaagcggcggagaatcgatttttcttccacgatttttgcataatactctatattagccgcagtcggcacagaatttgcaatatccgtcaaataagaaatgccgccaacctcttccaaaaggtccgtgttcgcaagctctgatgtcaccgtcaccaggtctacaggctcgccgcggtctccaagaacaagcatggcgttaaatattttttggtgcgacattctgtaaaaatcatctggaatcaagacttctgacgccaaagttaaagctgatggttctaaaaaaacagcacctaacacggcctgttcggcttcgatattttgcggcggcagcctgtcattcagaagatctgtcatgttaagcaccgtcctcccatttaaaaataacccaacgtctattttaccatttttacagaaaaaaaatagactcttgcagaatcgcatgttgtagaaatattttcatagaaagggagaacagctgtcggaatgtttgcttccctgatctatacgggaaacaaatcagtaaacaagtttcgggaggttgtttttcatgaaggtttatacggtatcaccaaatgccgagacagacgggtggtttttgaaactggaagatacggcgcctgttgagctttatgatacaaggacagaggccgtggaaaaaggagaagagatggcgaaagagaaccgtcctgcgaagcttgtcatctatgaccggcaggacaacaaagaagacgaacggtcttattaaacacctcggccgaggtgtttttttaaagattccacaattaatccacccggctgttccaactgtttttcaagggaatgctgaccatcaaatcggtcgcatgttggtacaaatcccattcttcataggccgcaaatttcatccgcagcgtttgcagcacattgcgcatatctttgtactcttcaaatgtgtaaagcccttttgctctgatctgctgttcatacaatttctttttcagctccgatatcgtcgatttcaagacgatcacctccgctttatttatatcgcttttttctttttcttccaactcacttgtcatatgatgttacaatatatattggagtcaatattcactgttgcgtactctgcgcgctggggtacaatataaaatggaggactttatgaaacctttacaaatttctgccgaaacggcgcaaaaactttcggaaaccttaaatcttcctcttgaacaaatcatgcatttgccgcagcatatcctgcttgcgaaaattgccgaaattcagaagaaagatcaatagtaaccttggatgatggtccgggtttctttttcatgtcacttttccacctggaagcaaaggagaatacagcatgcattacattgacgctcgacgcgcccgtttgaacaatatctttttgattgcaggaatcatatttatcgcttttaatttaagaccggctattacagctgtcgggccattgatcagttcgatccgctcggatatggatttgacgaacggcatggccggcttcttgacgacgctgccgctgttatcgttcgccgtcctgtccccggtcgcccctaagctcggacagaagcttggcaatgagagaaccctctgggtcggattggtcatcttattgatcggaattttgctgcgctcttacggagaatctattacattatttgcaggaaccgcattgatcggagtcggcatcgcaatctgcaatgtgctgctgcccagcctgatcaaacataaatttcctgacaaagcgggaattatgacaagtttctatacaacagccatgtcgatttttgcggcgctcgcatcagggatcagcattccgttgtcgcacggcttagcgtggggatggagcgcgtcgctcatggtttgggcgggcctcgcgtttgttgcgattttgatctgggttccccagctccgctatcatgatacgggaaaccgcacggtcagcttaaaggcagacggccaaacggtctggcgctcgaaaattgcctggcaggtcacattctttatgggcatacagtcgtttttgttttactgcacgatcgcctggctgcctgaaattctccgctcgcacgggatgagcatgtcgcttgccggctggatgctgtcgctgatgcagtttgccagcctcccgtcgacatttttgactccggttctcgccgggcggtttcaaaaccagaaaagcatcgtgctcgccctcggcatcctatacttggcggggatgtcagggctattgtacggaggcagtacagcgatgctgacgctatgggtcattttaatcggaattggacaagggtccagcatcagtttagccttgactttaatcgggctgagaagcgaaaatgccgatcaagccgcggcattatcagggatgtcgcaatccgccggatatttgctggcagcgattggtccaagctttgtcggttttctttacgatcacatgcactcatggaacggaccgattttactgttcatcggcgcgctggtcgctttgatcggtgcaggactcggtgcgggaagaaatcaatatatctatgctaaagcagcataacgaagccggcagataagccggctttttttttggaatataacctgacaaaccagcggccaaataaaccgtgatgccgtatgatcagatttgacaaaaataattcacttattggtctagacaactagagttgtaatgttctatactgatgataacgttttcaagaaaggacttttgactgtgaaaaccaaaccatctcaacgctatatttttaaacatcttcatatttacagtgaaaatggaatgatagaagacggttttcttctgacgaatggagaaaaaatcgaggcttacggaccaatggctgatattccagcttccgcacaaacggcagaacagctgacatttccggagaacttcaaagtgctgccgggcatgatcgatgtccacattcacggggcaaacggcgcagatgtcatggacggaacagccgaggctttgcaaacaatggctgaagccctgccgaaagaaggaacgacaagcttcctggcgacgacgatgacccaagataaagccacgatcgagcatgcgctggcaaacgttcaccggtataaggaagccggcggacggcccggaacagccgaagtattaggcgttcacttagagggcccttttatttcagaaaagcggtgcggcgcccagccgccggatgacattatagcgccggatctttcgttatttaaagaatggcagcgcatctcagggaataacattaaattagtcacacttgcgccagagctggaagggtctttggaactaatttcctttttgaaggaaacaggggtcatcgcatccgcaggccattccgacgccggactcaaagagatggaagccgggattaaggccggcctctcccatgtcacccatttgttcaacggcatgcgggggctgcaccaccgcgagccggggactgccggtagcgctcttctgcatgatgaactgaaggctgaagtcattgccgacggcatccatgttcaccctgccgtcatcaagctggcatttcagcaaaaacagaaagaaggcatcattttaattacggatgccatgcgcgcaaaatgcttgaaaaatggaacctatacattaggcggacaggaggtgttcgtaaaaggcgataaagccgttttacgggatggtacgcttgccggcagcatcttgaagatgaaccaggctgcactgaacatgatggattttacgggatgttcactcgaagatatcgtctacatgacagcagtcaatcctgccagacagcttcatatttatgaccggaaaggcagcatacggagcgggaaagatgccgatttgatcattttaaatgaaaaaaatgaagttgtgatgacgctttgcaaaggcgtgattgctttcagcaaaagggaggtttcaccatgaagatcattgaagctaaagattatcaggacatgagccaatcagccgcccgattcatcatcgagcaagtgaatcgcttatctgcacctgttctcggccttgcaaccggaggaacgcctctcggcacatatcaggttttaagggaagatcatgcgcgtaataaaacgacttacaagcacgtctatactgttaacttagacgagtatgtcggcgtttccccggatcatgaaaacagctatacattctatatgaaaaaacagcttttcgatcacattgacatcccgctcagccacacccatcttccgaacgggatggcttgtgacctggatgccgaatgcagccgctatgaagcgctgatcgagcggcttggaggcattgatcttcaagtgctcggcctcggcttgaacggccacatcggatttaacgagccgggcaccccattttcatcgaaaacgcatacggttgaactgacacaatcaacgaaagaagccaatgcccgctattttgattcctatgacgccgtcccgtcgcaagcaataacgatgggcatttccacgatcatgaaaagcaagcagatcctgctgctcgtttcaggagagaaaaaagccggcatcttggcgaagctgctcactgaagaaccaaatgaagacacccccgcttccgtcttaaaaacgcaccaagacgtcgtcatcatagcggacagcgatgctttatcaatcgtgaaagaaaggggtatggccttttgatcaaaaaagattcccacattccgatttactatcagattgagaccgaaattaaaaagcttgccgaaacaaaagatttgaaacccggcgacctcattccttctgaaagagagttcgcagaaaaatatgaggtgagcaggatgaccgttcgacaggcggttaacaatctcgtcaatgaaggcattctcgtccggcagcggggaaaagggacatttattgccgagccaaaaattgagcagcctctcaaaggattgacaagcttttccgaggacatgaaatcaaggggcatgaggcccggcacgaaaatgctcggcttcggcgtcatcccgtgcgaccagagcacagcgcgcaaactggagatacgtgaaggggcttccgtctatgaagtcaaacggatccgcctcgccgatgacatcccgatggcttatgaaatctcctatttgcccgccgacttcattaacggcctgaccgaagacattatgagcgcatctttgtacgactatgtcgaaaatacgctctcccttacgatcgaccgggccgcgcaaacactagaaccggcgattgcctctcaggcagagagcgagcctctcgacatagaggaaggcgcaccagtcctgctcattgaacgcttgagctatttggacgacggcagaccgtttgaagtggtcaaatccgtttacagaggcgaccgctataaattcgtcattgatatgaagaggaaagaccaatgaggaagacagagaatacgaacgacaaaagcacagcacttgatgaaatgaatgctttagatatcgtcaccttgatgaatgaggaggatcacacagtccctcgcgccattacgccctgccttcccctgatcgctgaagcggcggagacgattgtcagccgttttgagcaaggcggaagagtgtttaccgcaggcgccggcacaagcggcagaatcgcagttcttgatgccgcggaactgccgccgaccttctctattgacgagagccgttggaccggcctgatcgccggcggatatgacgcaatgtggatgcctcttgaagaaaatgaagatgaccgtgaaaaaatcgtcgctgacctgaaagcgcaatcattctcgaaagatgacgtcttaatcggagtcactgcgagcggttcgaccccttatgtcctcggcgctttatcctatgccaaacagatcggagccgcttctgtttcgatcagctgcaacgcggatacagaagcgggcaaattaagcgatatcgcgattgaggttcaaacaggaccggaaattatccgcggttcaacgcggctgaaagcaggaaccgctcagaaaatgatcttgaacatgctgtcaacagcggcaatggtgaggcttggccgcgtctatcaaaacgagatggtgaatatgaggctgctcaatcaaaaattagccgggcgcgctgtcaccattctgatgaataccaccgggttatcggaggatgaggctctgcaagctttaaaagaaagcggcaatgacatcaaggcagcgatctttatgacgttgacaaacggaacgcttgaagatgcccgccgctgtttatcccatgaaaatggacatttgaaaaaagcgattcaatatcatcgaaaggggttttaactatgttgggatttcttcaaaatatcggccgcgcgctcatgctgccgattgccgttcttcctgctgcgggcctcctgctcgcactgggacgggaagacctgttaaacattccgtttatcgctgcttcaggacaatcaattcttgaccaacttccgatcatctttgcgataggcgttgcgatcggattgtcaaaggatggccacggggccgccgctctgtccggagccatcggttattttgtcctgacaggcggcttagcagccatcaataaggacctgaacatgggagttctcggcgggattattgcaggcgttgtcgccgccgtcatgtataaccgctttaaagatgcaaagctgcctgactggctcggtttcttcggcggaaaacgcagtgttccgattatgacagccttctgttccatcattcttgcaggcattttcggcttcgtctggatttatgcacagcaggcaattgacgccattggaggatggatcattcatgcgggggcattaggggtcgggatattcggtcttttaaacaggctgcttttgccgctcggccttcatcacatcttaaacaacatggtctggatggtctttggagaatttgcaggcaaaacgggtgacatgaaccggttctttgccggagatccaagcgccggcgcctttatgacagggttcttcccgatcatgatgttcggtcttcctgcggcgtgtctggcgatgattgccgctgcgaaaaagcatcgccgcaaagcaacggccgggttgctgatcggattggcgttcacatcatttttaaccggaatcacagagccgattgagttcacattcatgttcctgtcgccgcttctcttcggtattcatgccttgttaaccgcaagcgccatgaccgtgaccaatatgctcggcatccatcacggctttaccttttcagccgggacgatcgactatctcttaaactttggaatcgccacaaagccgctgctcttgctgccgcttggtcttgtttacggcattatttatttcatcatcttttatttcttgataacgaagctcaatttgaaaacgcctggacgagaagatgacgatgagcaggaaaacaccgctgtcagccctgacacaggatcgtctaaatacgaaacccttgcggacaaatacatcgaagcgcttggcggaaaagaaaacatcgagacgctgaacaactgcgtgacccgcctccgcctcaaggtccgcgatgcttccaagctggatgaaagcgcgatgaaatccatgggagcgaagggattcgtcaagctcaatcagcacgaggtgcaggtgatcatcggtacagacgtcgaattcttggcgaatgaaatgagaaaacgtacggaataaaagataagccccttctgaggaaggggctttgttactttatgattgctctttcacgtgaactttcagtgttgcttgtacttccggatggagcttcacgggaacattcgtatatcccaatgagcgaatcgcatcgtttaattcgattttgcgtttgtcgacttttaactgatggcctttttgcagcgcatctgcaatttgtttgcttgtcacggagccgaataaacggccgccttctccggacttggctgaaagctccaccgtaatctcctcaagctgttttttcagctctttcgcagattttagttcttcagccgcttctttcttctcttttttcttctgaccttcaagcgcgctgatattggcggatgtcgcttcaacagccagcccttttttgatcaaaaagttgtgcgcgtatccatccgctacatttttcacttcgccttttttccctttgcctttaacatcctgtaagaaaattaccttcatttctgaatgcctccttcgaaatactcgtcaatcgcttctttcagtcggcggagcgtttcttcaaccgtgatatcggtcagctgtgtcgcagcattggttaaatgaccgccgccctcgagcgcttccataatgatttgaacatttacttcgccgagcgatcttgcgctgatacataccgtgttctcgtctcttctcgccacagcaaatgacgcttcgacatcgctcatagacagaagagaatccgcggcttgtgcaatgataacctggtcaaagtattcgtccgcctcatcgtccggcagcgatgcaatggcgatgccgttttgataaaaaacggtatgctggataagcttcgcccttttaatataatgatcggccgtttcttttaaaaacttttgcaccaatacagtgtcagcgccttttgcgcgcagataagacgccgcatcgaacgtacgggagccggtgcgcagcgagaagctcttcgtatcgacaataatcccggccaaaagagctgttgcttcgatcatgttgatttttaagcgcttcggctggtattcgagcagctctgtcacaagctccgctgtagatgaagcgtacggctccatatagacaagcagcgggtctttaataaactcttcccctcttctatgatgatcgataacgacgatattttcaattttattgaccagcctttcttcaatgacaaaagaaggcttatgcgtatcaacgatcacgagcagcgtgtcgtcttttgcgatctcaagcgcctcttccggcgtaataaacctggaccacagttcttcgtattttttaatctccccgatcagtctttgaacacttgaaccgatctgattggagtcgatcacgacaaagccgtctttgccgtttgcctgtgcgaccttcaaaatcccgatggctgatccgatcgaatccatatcgggaaacttatgacccatgattatcacattgctgctttcagagacaatctccttgagcgcgtgtgaaatgacccgggctctgacgcgcgtccgtttttccataggattcgtcttaccgccgtaaaacttcactttcccgttcggctgcttgattgccacctgatctcctccgcgtcccagcgccaagtcaaggctggattgcgccaaatcgccgagctctttcaacgaggcaacagatgcaccgattccgatgcttaacgtcaaggaaatggtatgaacggatgtcttctcccgaacttcatcaagaatcgaaaactttgatgcttctagctcgcttaaaatatgttcgtttaatacgccgatgaaccgctcagaggaaacccgttttaagaaaatgccgtactcttgggcccactggttcaaaagcgatgttacttcactgtttatcgagcttctggtctggtcatcaagcccttgcgtcacatcgtcgtaattatcgagaaagatgtaggcaagaaccgttctttcattttcgtattgtttttcaatctgcgtctgctctgtgacatcaaagaaataaagcagcttttcttcccgtttgatgaccacattaaatttccgctcattcagcgtaatcgtttctgtgtccacttcctgcttaatcaaagggacgacagattcacaagtatcataaagcgaccggccgacgagcgtattttcattaaagcatgacgccataaaaggattggcccattcgatatagtactgatcgttaaacagcatgatcccgatcggcatttcaagcagcgcctcttctccgacttttttcagacgataagacagcgtcgatatataattgtccagctcttttctgatttgggagtcggcccgcttcaaaaagtacaaaatgacacccagaatcagaacgccggccgcccctgccacccaattaaaataaatgttgatgaggacagaaatgattgtgacgacgattaaagaatatatgggatatcgaaataacggtttttcataaaaacttggcactcaaatcaactcctcaccattggagaacatcgcggctacgattttttcactctttctctcaagttaaagcctatatcaattatacctaagatgcgaacaaggtacagcaggggcgaaaacaacccgataattaaaaaaagaaccggcaggacagttggcagtttcttggcatggcaaaagtaaaacacaaatgaaaacccttggatgaccaagacaaagcccatgatgagactcgcatttaacagaacagagtaatatacactgccctcttcaacgggagccagcgacagaagaatcgtcaacaaatagatccaaataatgctttgcggaagtctcatatccctgaacggtttcagagacggtatttgtatgatgcgccgaagcaccggctttgcgagcagatgattcaaaaacgcagtgattccggaaaatatcacaatggccgtcggatataaatattgcgcctgtttgaattgctcatttaacaattcaatctgcttagccacttctttatcatttccaaactgtttgatactcgattcaaaggttttgaatgtttcattatatgcttgattggccgtctctattaagtttaatccaagaaactgaatgctgatgataagcagcaggacgaacgaaaccatatatgtaacggctgctgcagcaatcgcttgggccggctcttttcttctgtagtaaaagcccatgatcacgcccgcggcacttactggaatagcaaacatcagtccgcctaaggaaccggcaatcaatgaaacgggtaaactgaccaaccccaccgaaatccccggctttagaccgtgcctgatcgtttgaaccattgcaggcagcggcagcgtcaataaaagaatggttccgatgaaaggaatatagaggctgatcatcagcaaaacggcaaaaatactgaccatgatagcgccttctactaaagctcttgtttgtttcacttgttcacctcgtatgttgaaatgtcatgaatcaaaaagagcagcatagacgactgctcttttctaacgtcgcaatttcattttcaaataaagacgatgagatgagcaggtctcggccttctctcattgtttctttattctaacataaggtcaaatcgcaagtaaaacgatcataaggcttgagaaagcgagtgaatgttccatgtgaaacagtgtcagtcgagaaaccccgatttttctttatttttctttctcgcctttctgatcagcaacaatataatcaaaactgcgaccagaagcgtcacgcgaagccctccgctcaaaaatagaaaaaagtccttcaacatatccaacacattgatcacctctcactgttgtcacttagatgcaaaaatcccgtattatttgacttcccctttccaaaacggtctaaaacgtccctcagattcttcttaacctttagacggtaatgggcatatgctgactaagaaaaagcaataaaggagaatatgaatgacaacaaaaacattggcttggcatgaaacgttggagttgcatgaactaatcgcggcacagtctgtcggattggtgaagatcaagaaaagcatgaagaaaatcagcgaccctcagttaagacagctttacagcgtgtcagcaaaagcaaaagcattggagcaaaatttaagagagcttcttccctttttgccaaaagctccggcatttcagcgggaggatgaacgggctgacttgtattttgatgcgggtgatctgttggtgctggcgaaaacgaccgttcgaaactatgcgattgcgatcacggaaacggcgacgcccgagctcaggagagtgcttgttaaacaaatcaatgcggccattaagttgcatgaacaagttttttattttatgtaccaaagaggcttatatcccgcctataacctcgtcgacctgctaaaaggcgacgccatgcatgcgcaaaaagcgatatcgatgagataaaaaagccagcgaggatagaatcctcactggctctgttttttgctattttacgattaaaaccggacacttcactcttttcgccactttatggctgacacttccgagcaccatttcctgcaaagtgttcagccccctgcttccgataatcacgatatcaacatcatgatggttggcgtacgatacaatggccgggcccggatccccgtgctgcatcgtcatttgatagggaacggccgcctgttttaatttattttctatcgacagcagcctgctgcgccgttcgcgttcgagttctgtacggttttcgctatgcaggacttcatgttttgctctcgcataatccaatacataaatcatgtcgacgaccgcttcgtttgacatggaagccagatgaatcgcatgatcggcagctctttcagaatgcttggaaccgtcagcagccagcagtatatgtctatacacccttcatcacccgtttcttagtgatttgacactgaacgatgaggttgatcataggttgctaatttttcgaccagcttccagctggattcatttaatccaatcaagtcaacatctattccttgctctttcattttcaaaacgactttatcgatagccgccacagcggaatcatcccatatatgggcctcagaaaaatcaagaatgacctttttcgtttgctctcccgttttaaaggagtttacgaaatcttgaaccgatgcaaagaaaacttgtcctttgatgatgtacttgaccgcgttttcttctgacttttcttcaatttttagtttggagattttcgctacgaagaagattgcgcttaaaatcacgccggcgaaaaccccttttgataaatcgtgggtggccacaacggtaacgacggttacaatcatgacaatggaatccgtcagcggcacctttcttaacatgctaaacgaagaccagtcaaacgtcccgatcgataccataatcatcacgccagccaaagctgccatcggaatttgtacgacccagtcgcccagcaccatgattaaaaacattaagaagacaccggcaacaaaggtggacaagcggcctcttcctcctgattttacattgatcacagactggccgatcatcgcgcatcccgccatgcctccgaaaaaaccggcgacaatgttggcgatgccctgtccgcggctttccctgtttttgtcgctttccgtatccgtcatatcatcaacaatagaagaggttaataatgactcaagcaagccaacgatggaaagcgcaaaggctgttggaaaaataatggccaatgtctcaaaattgaaaggaatattgggaatcataaaggcaggcaatgattgcttcatttctcccaaatcaccgacagtgcgcagatcaaaatgaccgaaaatggcaaatacagtcatcgcaataatggcaacaagtgcagatggaacggcttttgtaaagcggggaagaacatagataatcaacaacgtaataccggccacaacatacgtcatattcgaaactccaacaaaatgaggaacctgcgccataaagattaaaatggccagcgcatttacgaaacctaccataaccgaccgcggaataaatttcataaagcgcgcaatcttcagcaccccaaatattaattggatgattcccgttaaaatcgtagcagcaaataaataatcaagcccgtgatctctgaccaaagttcccatcaaaagagccatcgccccggtcgcggctgatatcatcgccggacggccgcccgtaaaggaaatgacaacggcgatacaaaaagatgcgtacaaacctaccatcgggtctacacccgcaatgatggagaacgctatggcttcaggaatgagagcaagcgctacgacgatacccgaaaggatatccccccgtacattagaaaaccattcgctatttaattgtttaacattcaaagattcaacacctcgttcgtgatcatttgcttctaactctcatagaagccatctgtttttaacatgtttcactttagcaaacctgtatcaaaatgtctatatggttttttttgccgcggccgtttactccccgcactcccgtggaaataaacacgaagaaattaagaatgtaattttgaaaagagtccaatctaaggattagagggggtttcaacatggcgcaagagctggaaaaacggccggggcatacaagatggtatatttcttctttattaagcagcatgatcattttaaattactttgaccgtgttgccatttcagtcgcagctcctgcgatacaggattcctttcaattgacggcaacccaattaggcatcgtcttttccatctatacctactcatacacgctgatgcagattccggtggggagtctcttggataagtacggcgttgcctgggtgacaagggtcggaatgaccttgtggagttttctaaccattatattggcttttttacagggaaaactgcttctttatattgtcagatttttaatcgggctgacgagtgcttcagcttttcctgccgcatccaaagcaacggccttatggtttccgcctaatgagcgcggccttgccaattccttgtttgactcggcagccaagttcgcgaatgtcatcggcgcgcctctcgtagcctttttagttacgacattcgactggcgagccgcttttttaacgatcggaatcattaatgtactgttcaccgtatttttctggttgtattatgaacagcccgatcggcacaaacgaatctcaaaggaagagctccattatattcaaaagcataatgccgtatcagaggaagatatctcggaacggacgcttattgctttaaaagcgatgctgacaaaccgtaaagtatgggggctgatgatcggatttacgggttacggctatacattcaacctgctcttaacctggctgccgaccttctttaaagaaacatacggaatggacattatgtcctcagggctgtttacagcggttccctggctgatatcgacggtttccggaatcgttgtgggcggatggctcgtcgattttttaattcaaaaggggcattcgaatacaaaggtataccagaccattatcgtaatcggcatgagccttggatttgcctttctgggagctgttttcacgcacaacatcacgattgcgatcatttgcatttccgtcggcttagccggaatatctgcgaccgcgcctatcggctggtcgatatcagccgatattgcaccggttggttccatctctctgctcagttcaatggtcaatttggcaaataacttattcggagggattatcgcggtttcattaacgggctatctggtcgatgtgaccggttcatttacgctcagctttttagtagccggatttgtattactgctcgggctcgtgttctacctcgcagtcctcggcgatataaagcgaattcgtattggcaagcagaaaacctgaatgctgaaggaaacgacccggcttttgataaataaaaaaagaacaagaccgcattgggtcttgttccttttatcggcttactcgcctgctacgtatggaagtaaagccatttgacgagcgcgtttgattgcaacagtcaatttacgttggtatttcgcgcttgttcctgttacacggcgtggtaagattttaccgcgctcagagataaattttctaagaagatctacatctttgtagtcgatgtgcgtaatgccgttggaagtgaaataacacactttacggcgtttcgcacgaccgcctctgcgtcctcctgccatcgttatttccctcctttctgttctggttttattttattcgtccgtcatccattaaaatggcaagtcgtcatcagagatgtcaatcggctttccatcatttgcgaatggatcgtcattgaagctgttgccttgattgcgattctgattgttttgactgccgccgaatggagccggttcattttgtccgccgccaaagtgttggcctccctggcctccgctgtaaccgccggaaccagaaccgccgcctttaggctccagaaattgaacactttcagcttgaacttccgtgacgtatacacgctgtccctgctgattttcatagctgcgcgtttgcaaacgtccatctacacccgcaagacttccttttttaaggaaatttgcaacgttttcggcttgtcttctccagacaacacagttgatgaaatcagcttcacgttcaccctgctgattcgtaaacgtacgattgacagcaagcgtaaaggtggcaacagctgcaccgctaggagtataacgaagctctgggtcctttgtcagtctgccgactaaaacaactcggttaagcatattgagagaccatccttttgctttagagtatataattcaattctgtttattcttcttctttaaccacgatgtggcgaatgatgtcgtcactgattttagctaaacggtcaaattcttgaactgcttcagctccagcttgaacgtttaagatttggtagaatccgtcgcggaaatcgttgatttcgtatgcaagacggcgttttccccaatcttttgtttcagtgatctccgcaccgttagttgttaaaatgttgttaaaacgctcaacaacagcctttttagactcttcatcaacgtctgggcggatgatgtacatgatttcgtactttctcatttgtatttgcacctccttttggactaagcggcccattatattgggcaaggagcaataattctattactcacaattttatattatatcaaagctcttgtcctatttcaactgcgttatacattgaaacggaaatgaatgacatcgccgtctttaacaatgtattctttcccttcaaggcggacttttccggcctcttttgctgcggtcatgcttcccgcttcaagcagatcgtcgtaggcgaccgtttccgcacggataaatccgcgttcaaagtccgtatggatgatgcccgcacattcaggggctttcattccttttttaaatgtccaagctctgacttcctgttctcccgctgtaaaataagtagcaagtccgaggagggagtaggacgctttaatcagctgatcgagaccggattcttcaatgccgagttcttcaaggaacatcgccttctcttcgccttcaagctctgcaatttcggactcaatctttgcgcagacgacgatgacttccgcattttcagcagctgcaaattcccggaccttctgaacgtactcgttacctgaaggatcagccacttcatcttcgctgacattagctacatataagacaggttttgtcgtcagcagatgaagctgcttcaacaccttttgctgctcttcggagaactcgacagagcgggccggcttttcctgttcaaacgcctcttttaactttgtcaaaatctcaaattcaaacacggcttctttatctttttgcttggccatctttccgacccgcccgatccgcttttccacggtttcaaggtcagccagtatcagctcaaggttaatcgtctcgatatccgaaatcggatctactttcccggacacgtgtgtgatattgtcatcggcaaaacagcggacaacatggcagatcgcatctacttggcggatgtgggacaggaacttgtttccgagcccttctccttttgatgctccttttacaatgcctgcgatatcggtgaattcaaatgcggtaggaacggttttcttcggattgacgagttctgtcagcttttgcagacgctcatcaggcacctctacgatcccgacgtttggatcaatcgtacaaaacgggtagttggccgattctgccccggcctgagtaattgcattaaataaggttgatttcccaacgttaggcaaaccaacaatcccagctgttaaagccattgtttcatctcctctataatgaacatccgtgtgtagtcgtaaatgttaaacctgcaacaattataaggatgattacaataaaagacaagctgacaaaacttgcttttcaatcatacaaactagatgaaaattcatttttcattgagacagaaaaaaagcataaggaggtccgccaagattaactttcggactcctcatgcttaactaatatctttttcagctttctttgaaactctttgcgcgggatcatgacgctgtgtgaacagccctcgcacttgatccggatatccattcccatccgaatgatcttccagcggtttgtcccgcagggatgcggctttttcatttcgaccacgtcattcaggccaaattctttatcggccaacatcgttcacctctttgcttccttgttgtgaccttattgtacaaaaaaccacggtgaaagggcaattcttcacaatcttaactgtatttatttccatttactcaaaatcggatatagtaaaatatttaccaataaatataaattcaataatccgtaaattggatataaaaaagcgattaaatttgaaaatccgattgacgtaaaaggagccatgatcgagagaagcaggatgacgatcacccatctcggccagttcacaaaggacagaaaacggctggacagaccgagaatgctcgagatcgtcgtcgtatagattgcgacgcaaagtacagccgtcataaaaataaaaatcggaaaaggcgcgccctccaaaaccgcgaataaaggaatttcataatgggccagttcaccggcaagctctacaagggtctcattgtacatgtatgaaatagccccaaacaccaggccgcttaatatgctggcaatctttgcttctccgacccccttcatctctttgccgaccgcagataatacagcgacaacagataatatgttcagggaagtgaatgcgatgccggcaggccagttgtattgatgagtcaagttgagcagccacggctgatgatgagctgtttgaaaagaaatcagcgcatacagcagccccgccaccaaaatcgggattaagtagctattaacggacaatatgccattgagcccccacaaaaacaacaaccctgtgcataaacaaaacaagatgacgccagtccaaaacgggatatgaaagatttgcagcgttaccccgcctcctgcaatcatcacaatcgtcgtcgtaaacaaatacaggatgatcagcacatcgtatactttagccagcatcggaccgattaatgtttcgagcacaggcagaaaatgctctgatttttgttcatagctgatcttcatcacaatataggttgacaggctgaacatgatcgtaaacaacaggatagccagtccgctttcatcaccaaaaaactgccatatttcctggccggatgcatatcccgcacctattaagcttcctaaaataagaagcatccacttcatcccggctctccacacgatttgctcaccccaacaatatagtttttaagcttgtttctccgctcatgacactatattgccggtcctctataaaaattcatgaaacccttttcgacttttatcttacaaatgaataaattatattaatataacaaaatagaatatcgtatcctctcttagtaaagtattttttccggctgacaaaatcgactcatccaaagcataaaaaaagagacagctggatatactgtaaacaaccatacatactcaaaaaacacaccaaggcactgctgttaccatgatgacaaggatgtgaagcctatgaatcgaaaaggcggaattttttctcaagaaccaatgaatgaatatatttctcatacggatccgctagctgttaaacaaatagagaaagtcctttccgtctatttaaaggaagccggagaccggcccatcgtgatcgtttgcatcggtacagaccgctcgaccggagattcgctcggtcccctcgtaggaatgaaactctccgcaaagcagctgacacgttttcatgtctatggaacgcttgccgacccggttcacgccgtgaacttaaatgaaaagcttgatcatattcatcagcagcatcaaaatccttttatgatcgcgatcgacgcctgtcttggacgaaccaaaagcgtggggtctttccaaatcggcaaagggcctttgaagccgggagcaggcgttcagaaaagtttgccggaagtcggccacgtgcatattaacggaattgtcaatgtcagcggttttatggagtattttgtcctgcaaaatacaaggctcaatcttgtcatgagcatggcaaatgtgcttgcggacgggctgtcgcatctggaaaagaccggatcgcagcggcgccatgtgtcaccaattgaaagaatgaccggaagaatgtcataaaaaaaccatctgtacatgatcagatggtttttaagcttatgcgtcttcttgagccaataattcgagaatacgctccaagtcttcatttgagtagaattcgatttcgatcctgccttttttcttttgctttttaatggtcaccggtgttccaaaatagtttcgcaaatacgattcccgttccttgatcactgcatctttgacttgtttcggcttctttgtttcacgtggaacatcagcgttcaactgttgaattaacttttccaactggcggacgttcaactgttcggacacgaccttttgaacaagcggctcaagctttttcttgtttttcaatccaagcaatgttcggccatggcccatcgataacgtgccgttgtcgattaacttttgaacgtcttcaggaagtgtcagcagccgcaagtggttggcgatgtgaggcctgctttttccaagccttttcgccagctgttcctgggtcatatcgagatgtttgagcaaagattcataggcttttgcttcttcaagcggagacaggtcttctcgttgaagattttccaatagggcaatctccatcatcagggattccgacagctcgcgcacaatcgcaggaatggtttccaatccggccttttcagcagcccggaaacggcgttctccggccacaatgtcatagcctttaattgactttctgacgatgatgggctgcaaaacaccgtgctgcaaaatggactccttcaaatcttttaacgattggtcatcaaacgtttttcttggctgataagggttgggccgcaagtcttgcagcttgatttcctcaaccgtttcttcggataaatcaacatttgaaaacaatgcattaatcccttttccgagacctttaggcattcgcagccacttcctttgctaattctaaatagacttccgctcctctggaacggggatcatataaaatgatcggctttccatgactcggcgcttcactgagccggacattccgggggataaccgttttgtatactttatcgcggaagtactttttcacttcttcgatgacctgtatgcctaaattcgttcttgcatcaagcattgtcagcaatacgccgtcgatcatcagatccgtatttaaatgtttttgcacgagccggacagagttgagcagctggctcagcccttccagcgcataatactcgcactggaccggaatcacgacggaatcggaagccgtaagcgcattgattgtaagcagccctaatgacggcgggcagtcaataatcatgaaatcatagttttgtttgaccgattccaaagcccttttcagccggacttctcgggagatggtcggaacaagttcaatttccgcccccgcaagctggatcgttgcaggaatgacatccaagttttctacggatgttgttttgatgacatctttcacatctgcatcatctactaatatatcgtacacacattgatcaacatcagccttttcaacgccgataccgcttgttgcgtttccttgcgggtctatgtcgactaacaaaacccttttcccgatgtaagctaagcaagctcccaggttaacagaggttgtcgttttaccaacgccacctttttggtttgtgatcgcaataattttccccacaatgtcacctactttcacattgaacaagtttctctcatttctctattttaacaaaaaaagaatcggccgtttgctttttttgagtttttgttttttgaaagagatctgttttgtttatttttcgacaaaaagaaacagtttttttatcttagaaaaaagagaagaaacgctcaaataaagtgaaagatagttttaattttatatcagtataaaaaatcccccctgtgttggggggatttcaatcaatctgctgcgggcattttccgggtggcgatggcaatcctgttccaggcatttattgtgacagctgccatgatcagttcggctgtttcagcttctgtaaaatgggtcctgacttcgttgtatatttcatccggcaacccgtgctcgccgattcgcgtaacggcttcagtcagcgccaatacagcccgctctttttccgtgaaaaaaggcgcttcccgccacgcattgagcgcatatatccgctgttccgtttccccgttctgtcttgcatccttcgtatgcatatttaagcagaaagcacatccgttcagctgtgaagcccggattttgatcagttcctttaaaatggggtcaatgccagaagaagcctgcgctttttcaagctccagcattcctctgtatccctcaggatttactttttccattagaaatctcgtttccatgtctattcctcctttaagtgtttcacttatataacaagagagaaacggagtttgtgacaaaaaacgttatattttaatgtgcttcagtttatcgggatttgacacgataaacacatttttgacggaatcgccttccggattccaagcaaagcaaaccgcgtaagccgggcggttgtttttcatgatcaaaacgcccttttggtcgttgatatcgactggcataaagcggccggaaaagcttccctttgaaacaactcccgtaaaaaacgcataaatgcggctctttccatagatcggtctcaaagcgctgcgcacttttccgccgccatctgtatacaatacggcatcttcaatcaatttcttggaaaactcctcaaaattacctgttttcgctgattcgataaacagctgagccaattgctgttcttcaaccggctgtgaaaataccgaaatatcctcgtttaatttctgtttcagccggctgtggatttgacgacagttcgcttccgacttcccgataatggacgaaatttccttgtaatgatatccaaatacttctctaaacatcaaaacggctctttctacaggatttaatcggctcataactaccagaaaagcataggataccttttctttctcttcaacgtactcagccgggatttgagctgaaagcgccacctgcggttccggaagccattccccgatatatacctcccgcttcttgcgggcagactgcagttcatttatgcagcggtttgtgattgatttcgttaaatatgcttgaatatggtcaatttgaccgatatctttttcctgaaggtctgcgaacaattcttggatgatgtcctctgcatcttgaaaagacccgagcatacggtaagcaatcgaaaaaagcaatgaatgatattgtcgataatattccatagacgctcccccatagatattttgcctaaaaaaataaaagctctatagggagcttttatttcggtattcgaatcgtaaactgaatatattcttcaaattcctcttcttccgtattcagtttgacgccgctgtcttccaccattgataaggactggcgaatcgtattcatcgcgattctcgcgtccctgctgtacgcttttctctttggtttaggcttgcgtttatcctgctcaagcattttgacgacacggtcttcggtttgttttacatttaaactcttttcaatgacttcatgcagcagcttgacctgaaggtcgggctgtttcaacggtatgagcgctcttgcgtggcgctctgaaatttcttttttcaagatcgcttcctgcacctcttccggaagctttaacagtctgagcttattggcgattgttgactggccctttccaagcctttgtgcaagggcttcctgcgtcaaatcgtgaagctctaaaagccttgcataagcatgcgcctcttcaatcgaagataattcttccctctgaaggttttcgataagagcgacagaagcggtctctgtatctgaaaaatccttaataatagcgggaaccttctcccaatcgagcgtttgaaccgcccgccagcgccgctctccggctatgagttcatattggccttcccgctctgtttttctgacgacaatcggctggataatgccgtgtgtatgaatggttgcagctaattctttaattttttcttctgagaaaatggtgcgcggctgaaaacggttaggaattatatcgcctactggaatctcttgaatttcttctttattcgtatcatgttcagcaatctctgcttcttcttccttgtcgccaagtccgaagagacgagagaatgaatgcttcatgtacctacaccacctttaaacactgccatttttataattctattttctcatgaattttccttctgtgacatcacgaaatttgaagaaaacgaataatttaaccttcaataggagatttattaggtgttccaggctttcttggaaatttcttcggtgtctgcgattgttttttgatgacaatgatgtttctttcgctttcttctattggcagctgaaaagaatgtacggtttcaattttgcctccaagcgttttgatggcttttttgcccgtttcaatttcttcatcagccgaagcggcttttaatgctacgaataaaccgtcttttttcacaagcggaaggcagagctcgctgagaaccgaaaggcgggcgacagcgcgtgccgtcacaacgtcatagctttctctgtggtctttcgatcttccgaatgtttccgcgcggtcatggtaaaaagctgtgttttccagcttcaaagcgtctgacagctgattcaaaaagtgaatccgtttgttcagtgagtcaacgattgtgacgtgaaggtgaggaaagcagattttaatcggaaggcttggaaatccggcacccgctccaacatcacagagagtgttcatctttttgaaatcaacataaaaagaggcggcgatggaatcgtaaaaatgctttaagtacacttcttttttctcggtaatcgaggttaaattcattttttcgttccattcaacaagccattcgtaataagtctcaaattgctccagctggaaggaggaaagggaaatgcctttcttctccaaaccggctgtaaattgctcaatgttcatgccgtcaccctttctattccgcaaccttggcaatccgtccctgctctaaataaacgagcagtatggaaatatcagcaggattgacgccggaaatccgtgaggcctgtgcgacagacagcggtctgacctctttcaatttttggcgcgcttccgttgcaatgcctttgatcgcgtcatagtcgattctgtcaggaatctttttattttccattttctttagtttttcgacctgctgcaaggacttttcaatatatccttcatacttaatttgaatttccacctgttcggcaacgtcgccggcgactttttgttcaggcggcgcaagagcagtgacggtttcataattcatttcaggccgcttcatcaggtcggtcgcgcgaatgccgtctttgagctcgctgccgcccagtgaacggatatattcctgattttcctttgtcggtttgataataacagaatgaaggcgttttttctctgcttcaatggccgcttttttctcttgaaacttttgatatctttcttcagaaatcaagccgatctgatagccgatctcggtcaggcgcaagtctgcattgtcgtgacgcaggagcagcctgtactctgcacgcgaagtcagcaggcggtatggttcgtttgttccttttgtcacaaggtcgtcgatcaatacgccgatataagcgtctgagcggctgagaatgacctcttctttgccaagcgctttccggcccgcattgataccggccataattccctgtccggccgcttcttcatagcctgatgttccgttaatctgtccggctgtgaagagtcccggaatttttttcgtttccaatgtcggccacagctgtgtcggtacgatcgcatcatattcaatcgcataccccgcccgcatcatttgcacattctcaaggccgggaatagttgaaagcatttttcgctgcacatcttctggaaggcttgtcgacaatccctggacatagacttcctgggtgttgcgcccttcaggctcaagaaagatttggtgtctcggcttgtcgttaaagcggacgaccttgtcttcaatagacgggcaatatctcggtcccgttcctttgatcatgccggagtacatcggtgaacgatgcaaattgttgtcaatgatttcgtgcgtttccggacttgtatatgtgagccagcatggaagctggtctgtaatatattccaccgtctcatacgaaaaggcccgcggcacttcatcaccgggctggatttccgttttgctgtagtcaattgaatgactgttgacccgcggcggcgtccctgttttaaaacggacgaggtcaaagccgagctcttcaagatgttcagacagcttgatggacggctgctggttgttcggtccgctggagtatgacagatcgccaagaatgattttccctctcaaaaatgtccccgtcgtcagaacaacggtcttagaacggtactccgcccctgtctgggttataacgccccggcattccccgtcttcaataagaaggcgttcgaccattccttgcagcatggtcaaattcggttcattctcaagtgtctttttcatttcatgctgatattggaatttatcagcctgagcccgaagcgcccgaacggcaggtccttttcctgtatttaaaagcctcatttggatatgcgttttatcaatatttttagccatttccccgccgagcgcgtcaatttcgcggacgacgattccttttgcaggtccgccgacagacgggttacatggcatgaaagcaaccatatcaaggttaatcgttaagacaagcgtttttgcgccttgtctggctgacgccagcgccgcttcaacaccggcgtgtccggcgccgacgacaacgacgtcatattggcctgcttcatagcccatatgctttgttcctcctttattttcctaagcaaaattgagagaagagctggtcgatcagactttcgtgtacagcatcgccaatgatctccccaagaacttcccagcatcttgttaaatcaatttgaaccatatcgatcggcacatcgttttcgatgccctccaatgcgtcagtgatggcgcgcttcgcctcatgcagcagtgaaatatgccttgtattgctgacatatgtcaagtcgccgctctcgatcgcgcctgtgaaaaacagcgattgaatggcttcctccagctcatcaatcccttcctcttttaataaggaagtcgtcacgacaggctgattcccagccaattcccgaacccgatcaagatcaagcttttgctcaagatcggtcttattgacaatgacgatgatgtccattcccttcgttgcttcaaagagcttgatgtcttcatctgaaagggactcgctgtaattgaggacaagcaaaatcaaatctgcttcttttaatacctgtcttgaacgttcaacgccgattcgctcgacgatgtcttcggtctcgcggatcccggctgtatcgacgagacgcagcggcacgcctctgacattcacatattcttcaatgacatcccgcgtcgtgcccggaatatccgttacgatcgcttttgtctcgtggacgagactgtttaaaagcgaggacttgccgacattgggccgcccgatgataactgtcgagatgccttctcttaatattttaccctgctctgaagtcgtcagcagcgcctcgatttcctttttgacctttgtcgctttttcaatcagcatcttgtgcgtcatttcttcaacgtcatcgtattccggatagtcaatattcacttcaacgtgggccaatgtttcaagaatctcggccctcaaccgtttgatcagtgaagacagccttccttccatctgattcatggccacattcattgcccggtctgttttggccctgatgagatccatgacagcttcagcctgggaaagatcgattcttccgttcaaaaaggctcttttcgtaaattctcccggttccgccagacgcgctccctctctcaaaacgagctgaagcacctggttgacagtcacaagtccgccgtggcagttgatttctacaatatcttcccgcgtaaaagttttcggcgctttcagtaccgaaaccatgacttcttccacgactttttccgtttccggatcaacgatatgaccgtagttaatcgtatgtgaatcgacggaactcagcctttttccgcgaggtcctttatacactttatcggcgatcgcaagagcctcagggccgctcatccggacgatcgcaatcgccccttctcccatcggcgttgaaatcgcagcgatggtatccatggctttcacctctctttttcattcctatatctattatccccatttgccgggtcatcttccaaacatcgtatacggatgaaaaacttttattgtaatcaaaatttaaagataacatagtttcaattgaagtggaagtgacttgaaccgttatccacaaccgttctaagccatcattacttactttaacttatccacatgtgaataacaattaaatttcattttcatcaacagcttacgcctgaaaaaatagaacttaaactgattttgctgcatttcatcgattttcaacggcaaaaaaaccgaagccccaattttgggaacttcggttttcatgttattttttatatgagatgacaaggtgccggttatggtcttcaccggtagagtaagtttcgatatgctgcgagtagcccgcaagcgtatcatggatgaccttgcgctcactggaaggcatcggctccaggtgaatgtcttttttctgcctggccgcctggtcagcaagcttcaatgccagctgagcaagtgtttccttccgctttgcgcggtatccttcggcgtcaaccaccgcttggatatatctgtcggaatgacgattgagcacgagctgcgtcagcgtttcaagggcatttaaagtttgtcccctttttccaattaaaagagctgttttgtctcctttcaactgaaaaaccactcgtttagactcctcttctgccgtcacctgggcttgtattcccatattcgaaattacattttccaaatattgttttgcttctttaaccgggtctattttttcccgaatgttcacgactgcagaccgatgaccgaaaatgccgaataatcccttttttccttcatcaactacgtcgacttcgacatcatctgcatgaaggcccagctgttcaagcccggattgcactgcttcatcgacggtacgtccagtagcagtcagttccttcactttttcttacctccggatttttttcctccggctgccgcttcctgtctctcagcctttagatcaggccctttgataaagaaggtttgagcaatcatgaataagttaccgactacccagtacagggaaagagccgccgggaaactgatcgcaaatacaacgatcatgatcggcatcagccaaagcatcatcgccatctgcggattttgctgcgctgttcccgccatcatcagcttttgctgaatgaatgtgaacacaccggcgagaatcggcaaaatgaaatacggatcacgctccccaaggtcaaaccataaaaagctgtgttctgcgatttcccgcgttctcataatggcatgatagaatccgattaaaatcggcatttgaattaagatcgggaaacatccggcaagcgggttaaccccgtgcttctgcatgagagccatcgtttcctgttgaagcttctgctgcgttttttgatctttagaactgtatttttcacgaagtttttgcatttcaggctggagagcctgcatcgctttcgaactcttcgtctgcttgatcatcagcggcaaaattaaaagtctgattaagatcgtgacgatgataatcgctagtccgaagttttcattcgttaaatttgctacatacgtgatcagctgtgacaacgggtatacgatatacgtgttccaaaacccttcgctttctgcagtgatcggctggttgatttccgtacatccagctaaaagcacgataacgccgatcatactgaacaataataaaattcgcctcttcaacaacatttcctcctaaatcttcattcttcaaccggtattattcggttatgaccattaaaaagacatactttctcgtattttatcatctttctcccccgaatgggcgacgacatttttctggagctaaaggaagcgcttaaaaatgaggggccataacttcttttaacccggactatgatggctgattcggttttttccggtagacaaacgactttctgaaaagatgctgcaaactttttttcgtctcttcatatgataattcagctgcaggctttcttgcgatgataatgtagtcattttcttgttttaatagattccgctcttcctggatgacctggcgaatcagccgctttacccggttgcgcacgactgcgtttccgattttcttgctgaccgacagtcccacccgaaactctttcgcttcaggctggtgaagcacatataaaacatattgccggtttgccatcgattttccctttttaaatactttttgaaaatcttcatttttctttaatcgatttcgctttttcatatcttctttcactccgataacaagctggcaaatgggcctggtcattcctctatgtaaaaaagaccactgacattattcagtggcctaagctgataatacttttcttcctttgcggcgacgacgtgctaatacaagacgtccatttttagaactcatacggctgcgaaagccatgaactttgctgcgcttacggttatttggttgaaatgttcttttcatgtatgacacctccctcgaggaatagctgttaaagacagtctaatttattatattgggatgagcagttcattgtcaacttcgctcacacatttcttttttgcaccataataggataacacatatcaattttcttcgaaagcctaatttcatttttcctcaattttagcttaaaagatttttttggaagcgggaaaacgggatggacgaagcgaaaaaaagccaatgtggatatctttctcctcgttttttctatccacaatcattatcgacaacattttcacaaaactaaccgttgtggacaatatttcttcaacagtttgtatagtatgtggataagttcctcgcaaccattgcaaccactcgcttattctgatattatatttgtgttttaactcttgataacaaattggctgccaatccattatccacaaactgtggataagttgtggaaagttttttcacagggtgtgcagtattttgtccacatcttgtgaaaaatgtcgaaaagacgtttttctactatattatatgttttcaacatttcattaacgaatggactcatccatttgctctttttttgtgttctataacaggttggacaagcaaatattgctggtaaaggagggacgaaccgccattatgaaaaacatatcggatctttggaatcaagctttggggcagatcgaaaaaaaattgagcaagcccagctttgaaacatggatgaaatcgacaaaggcccattcattgcagggcgatacgctgatcatcaccgcaccgaacgagttcgccagagactggcttgaatcaagatacctgcacctgatcgccgatacgatctatgatctgacaggagaagaattgagcattaaatttgtcattcctcagaatcaaaatgaagaagattttatgccaaagtctccaatcaaaaaaatgtcgaaagaagaaccggctgattttccgcaaaacatgctgaatcccaaatatacatttgatacgttcgttatcggttcaggaaaccgattcgcccacgcagcgtctttggcagtggctgaagccccggcgaaagcttacaatccgctgtttatttacgggggagtcggacttggaaagactcacttaatgcatgcgatcgggcactatgtcatcgatcacaatccatctgcaaaagtggtttatttgtcatctgagaaatttacaaatgagttcattaactcgatccgtgacaataaagctgtcgattttcgcaatcgctatcgaaatgttgacgttcttttaatagacgatattcaatttttagccggaaaagaacagacgcaagaggaatttttccatacgtttaatacgctgcatgaagaaacaaagcagattgtcatttccagcgaccggcctccaaaagagatcccaacgcttgaagaccgtttgcgctcccgttttgaatggggattgatcactgacatcacgcctcctgatctggaaacaagaattgcgattttaagaaagaaagcaaaagcagaaggacttgatatcccgaatgaagtcatgctttatattgccaatcagatcgacagcaatatcagggagctggaaggggcattaatcagggttgtcgcatattcttccttgatcaataaagacattaacgccgatctggctgctgaagctttgaaagatatcattccttcttcaaagccgaaagtcattacgatcaaagacatccaaagaatcgtcggccagcagttcaatatcaagctggaggatttcaaggcgaagaaacggacaaaatcggtggcttttccgcggcagatcgctatgtatctatcaagagaaatgacagattcttctcttccgaagatcggcgaagaatttggcggacgcgaccacacgacggtcatccatgcccatgagaaaatatcaaaactgctgaacgatgatgaacagcttcagcagcagattaaagaaattaaagagcagctgagataagtgatgagcgggaaagtgtgaataacttgaacatggccttacacagtctgtccacatgtggataggctgtgtttccgttctttttttcacttatccacaaatccacagcccctactagtacttctgctatttttttaaaacataataattaatagattcccgcaaggaggatgattatgaagtttacaattcaaaaagaccgcctggtcgaaagtgtccaagatgtgttaaaagccgtttcttcaagaacgacgattccgatcttaaccggtattaaaatcgtggcctctgatgaaggggtctctctgacaggcagcgattccgatatttcgattgaatcgtttatcccgaaagaagacggcgatttagagatcgtgacaattgaacagcccggcagcattgtgcttcaagcccgttttttcagtgaaattgtcaaaaagctgccgatgtcaacagtggaaatcgaggttcaaaatcaatacttaacgatcatccgctccggcaaagcagagtttaacttaaacggtttggatgcaagcgaatatccgcttttgccgcaaattgaagagcatcacgcttttcaaattccgaccgatctgctgaaaaacctgatccgccaaaccgtttttgcagtgtccacctcagaaacacgcccaatcttgacaggtgtaaactggaatgtcactggcggtgaattaatatgcactgcaacggatagtcatcgtcttgcgctaaggaaagctaagctcgacattaacgaagacagttcatacaatgtcgtcatcccaggaaaaagcttaaccgagctcagcaaaatccttgatgaccatcaggagcttgtcgatattgtgattaccgaaacacaagtgctgtttaaaacaaaaaacgttctgtttttctccaggcttcttgacggaaactatccggatacgaaccgcctgattcctcaggaaagcaaaacgaacttgattgtcaatactaaggaatttctccaggcgatcgacagggcttcgcttttggcgagagaaggacgaaacaacgtggtgaaactttccgcagccgccaatgagtcgatcgaaatttcttcaaactctccggaaatcggaaaggttgttgaaacggtgaatgccgagcagatcgaaggggaagacttaaagatatcctttagtccgaaatatatgctggatgcccttaaagttcttgaaggagaggacattcatgtaagcttcacaggcgctatgaggccttttctgatccgtacgccgaatgacgattcgatcgtccaattaattcttcctgtccggacgtattaatttgttggaatagaaagttgccggctggtccggcagcttctcttattttttctggagaaaagcgctctcgccctgccttgattgctcataccgcaagtttcccctttccttctttccctgttttttagtacaattagatattagtgatattgaaagaggtcgatataatgacaaagacggtggctattgatacagagatgattaccctcggccagtttttgaaattggcggatgtcattcagtccggaggaatggcaaaatggtttttatcggaatatgaagtactcgtcaatgacgagccggataaccgccgcggacgaaaactgtatgtcggagatgtggtgacgattgaaggattcggttcatttcaagtcgtcggctaaaagcaggtggtattgattgtatatccaaaatcttacattatcgtcttaccgtaattatgagcgccttgaccttcaatttgagaacaaagtgaacgtgattatcggagagaacgctcaaggaaaaacaaatttgatggaagcgatctatgtgcttgcgatggcgaaatcccatcggacgtcaaatgataaagaactcatacgatgggatgaagactatgctaaaatagaaggcagggtcattaaaaaaaacggttctgttcccattcagcttgtgatttccaaaaaaggaaaaaaaggtaaagtgaatcatattgaacagcagaagctgagccagtatgtcggggctgtcaacacgattatgttcgcgccggaggatttaaatctcgtaaaaggaagtcctcaggtcagaagaaggtttctcgacatggaaatcggccaagtatcacctgtctatcttcatgacctttctctttaccaaaaaatcctttcacaacggaatcatttcttgaagcagcttcaaacgagaaagcaaaccgatcaaacgatgcttgacgtgctgacggaacagcttacggaattcgcggcaaaggttgtgatgaaacggcttcagtttgtcgatcagcttgaaaaatgggctcagcccattcattccggaatttcaagaggtctggaagagctgacgttaaagtatcatacgtctcttcacgtatcagattcgcccgatttgtcgaaaatgatcaatagttatcaagaaacgttttctaaattaagagataaagaaatagaacggggggtatctctttcaggtccccacagggatgatgttcttttctatgtcaatggccgtgatgtgcagacttacggatcgcagggccagcagcgcacgactgcattgtcgcttaaattggctgaaatcgacttgattcaggaagagataggagaatacccgattctgcttttggatgatgttttatcagagctggacgactatcggcagtctcacttgctccacaccattcaaggccgcgttcaaacattcgtaacaacgacaagcgttgatggaattgatcataaaaccttaaacgaagcggaaatctttcgtgttgaaaatggcacgctatcggactgaaaaaatggggtgagggattgtatatccacttaggtgacgattttgtcgtctcaacgcgtgaaattgtggctatttttgattacaaggcaaagacatcgccgattgttgaggagtttttaagcaagcaaaaacagcggattgtctcttctaacagcacgccgaagtcaattgttgtcacattacaatcgatttatttttctcctttagcctcaggcacgttgaaaaaacgggcgcaatccaagccggaaatcgattcataaagaatcttaactataaatttattatgtttgaagaaaagtgtaggtgaatgtgcgtggcaatggaacagcaaaataattacgatgaaaatcagatacaggttctagagggattggaagccgttcggaaaagacccggaatgtacatcgggtcgacaagcggcaaaggtctgcaccatttagtatgggaaattgtcgataacagcatcgatgaagcattggccggttactgcactgaaatcaatgtcgcaattgaaaaagacaacagcatcacagtaaaagacaacggacggggtatcccggtcggtattcatgagaagatgggtcgtcccgctgtggaagtcatcatgactgtcctgcacgccggaggaaagtttgacggaagcggatataaagtttcgggcggtttgcacggcgtcggtgcttctgttgttaacgccctttcaaccgagctggatgtaacggtttacagagatggaaaaatccattatcaggaatttgaacgtggcgttccgaaagctgatttgaaagtcattggagatacggaagtgacgggaacgaccacacacttcaagcctgatccggaaatattcacggaaacgactgaatacgactatgatacgctcgccactcgtgtccgcgaactcgctttcttgacaaaaggcgtcaaaatcacgatcgaagacaagcgagaaggaaaagaacgcaagaatgaatactgctatgaaggcggtattaaaagctatgttgaacacttgaaccgttcgcgggaagttattcatgaagagccggtctatattgaaggatccaaagacggcattacagtcgaggtggctcttcaatacaatgacagctatacaagcaacatttattcatttgctaacaacattcatacgtatgaaggcggaacccatgaagccggctttaagaccggtttgacgagggtcatcaatgattacgcgagaagaaacggcgtattcaaagaaagcgatccgaacttaagcggagaagacgtccgggaaggtttgacagcgattatttcaatcaagcacccggatcctcaatttgaagggcagacgaaaacaaagctcggcaactcagaagcgcgtacgataacagatgcgctattttcagaagcgcttgaaaagtttctgctagaaaacccggattcagcgaaaaaaatcgttgaaaaaggggttatggccgccagagcacggatggctgcaaagaaagcacgcgaattgacgcgcagaaaaagcgcccttgaagtgtccaatctgccggggaaacttgctgactgttcttctaaagacccgacgatttccgaactttacatcgttgagggtgactctgcgggcggatcggcaaaacagggccgcgaccgtcatttccaagcaattttgcctttgagagggaaaattttgaacgtcgaaaaagcccgcctggacaaaatattgtccaacaatgaggttcgttctatgatcaccgcccttggcaccggaatcggggaagatttcaaccttgaaaaagcccgctaccacaaagtcgtgattatgacggatgccgacgtcgatggtgcacacatcagaacattgctgctgacctttttctaccgctacatgagacagattatcgaacaaggatatgtctacatcgctcagccgcctctttacaaagtacagcaggggaaacgcgttgagtatgcgtacaatgaccagcagctcgaagaaattttaaaagagcttccgcaaaatcctaagccaggcctgcagcgctacaaaggtttgggcgagatgaatgcgacacagctttgggaaacgacgatggatccagaaacgcggacattgcttcaagtaacgctcaaagatgcgattgatgcggatgaaacctttgaaatgctgatgggcgacaaggttgaaccgcgccgcaacttcatcgaagagaatgcccgatatgtaaagaatttggatatttaatgattgtaagaccttattttcgcttaattgaaataaggtcttttctagaatgagcctttggcgctctagtcatttgatgtgtataaaatcaagattattgatataatggagaatagcctaattcgttgaagagtataaatacaaatctactcccacacaactcatgtagattctccagggaggttttttaatgagtgaacaacataagccccaagttcaggaagtcaatatcagtcaggaaatgcgcacatcttttttagattacgcaatgagtgttattgtttcccgcgctcttccggacgtaagagacggtctgaagccggtgcacagaagaatattgtatgcgatgaacgaccttgggatgacaagtgataagccgtataaaaaatccgcgcgtattgtcggcgaagttatcggtaagtaccaccctcacggtgattctgctgtttacgaagccatggtcagaatggcgcaggattttaactatcggtacatgctcgttcaaggccatggaaacttcggttctgttgacggcgactcggctgcggccatgcgttacacagaagcgagaatgtctaaaatatcaatggaaattctgcgcgacatcaataaagacacaatcgattaccaggacaactatgacggttcggaaaaagagccggttgttatgcctgcgagatttccgaacttgcttgtcaacggagcggccggtattgctgtaggtatggccacaaacatcccgccgcatcagctcggtgaagtcattgacggtgttttggcggtcagcaaaaaccctgatatcacgcttccggaattgatggagatcattcctggacccgacttccctacagcagggctgatcttgggaagaagcggtatccgaaaggcctatgaaacaggccggggatcaattacgcttcgagccaaagctcaaatcgaagaaacatcttccggcaaaccggtaatcattattacggaaataccgtaccaagtgaataaagcaaggctgatcgaaaaaatcgccgatctagtgcgcgataagaaaatcgacggcattacggatctccgcgatgaatcagaccgaaacggaatgcgcatcgtcattgaactgagaagggatgcaaatgccaatgtactgttaaataacttgtacaagcagaccgctcttcaaacatcattcggcattaatcttttggcgcttgttgacggccagccgaaagtattgagcttgaagcagtgtctggagcattatctcgaccatcaaaaagtcgtgatcagaaggcgtactgcattcgagcttcgcaaagcggaagcgcgggcccatattcttgagggcttgagagtggcgcttgatcaccttgatgaagttatttccctaattagaaattcgcaaacggctgaaatcgcaaaaaacggattgattgagaagttttctttgactgaaaaacaggcccaggcgattttggacatgcgtctccagcgtttaacagggctggaacgcgaaaaaatcgaagaggaatatcaaagccttgttgagctgattgcagagctaaaagcaatcttagcagacgaagagaaagttcttgaaatcattcgggaagagctcacagaagttaaagagcgctttaatgatgagcgccgtactgaaatcgtgacatcgggccttgagacgattgaggatgaagatctcatcacgcgcgagaatatcgttgtgactttaactcataacggatatatcaaacgtctgccttcttctacttaccgcagccaaaaacggggcgggaaaggcattcagggcatgggtacaaatgaagacgacttcgttgaacacctgatttcaacatccacccatgacaccattctcttcttctcgaataaagggaaggtgtaccgtgcgaaaggatatgagatccctgaattcggacggacagcgaagggaattccgattattaacctgcttgaagtggaaaaaggagaatggatcaacgcgattattccggtaggcgaatttgatgacgagtcttatttgttcttcacgacaaaacacggaatatcaaaacgcacaccgctttctcaattcgcgaatatccgcaataatggattgatcgccttaagcctccgcgatgaggatgaattgatcgctgtccgcctgacggatggaaataaacaaattattatcggcacgaagaacggtctgctcatccgtttccctgaaacagatgtaaggcaaatgggaagaacagcagccggcgttaagggcatcaatctgacagatgacgatgttgttgtcggcatggagattttggaagaggattcacacgtgctaatcgtaactgaaaagggctacggaaaactgacgcccgcttcagaatacagggtgcaaagccgcggaggaaaagggctgaaaacctgcaaaatcacagaaaataacggatctcttgtgacagtgaaagcaacgacaggagaagaagatttaatgatcatcacagcaagcggcgtgatcattcggatggatattaaagatatctccacgaccggacgcgtcactcaaggtgtgcgacttatccgcttaggtgaacaagagcatgtcgcgactgtcgctttagttgaaaaagatgaagagaacgattcagaagaacaggaagcggatgaatcataaaaacatgcagccaaatggctgcatgtttttctattcaatctttcaaatataatcttttcatcaggaacataatgtgctataatttctcttggtcgcttataaaaacaacaacaaaaactttttcaaaaaaagtattgaccgcttgtctcataaatgttatatttaagtggtcgctttgagagcggcagcgaagttctttgaaaactaaacaagacaaaacgtacctgttaattcattataaatcgcacatgtacctccgctgccggaggttttttgtttggaaaatatttaaatcaaaattttaagtgcaaggttattgacattctttattactttaactaatatttaatcttgttaactatttattttgttgtgcagaggtaaaaacaaatttaccgtttccgatctttcttgctcagttttgaacaacttattcagtacacgtcccgcaagctgctgagcaggaaataggaaaagcaaaaccgagggagccgttcaaaccggcttcacccaaaatataaggatatgaaaggagaaataaaacatgagcaaaggacgtttaattgcgacgaacattatcggactcatcatcgtgcttgccatcttagcaggaggtgcgtatttctattatgacagcatcagctatgtgaaaaccgatgaagcgcacgtggcaggcgagatggccgatattacggcgcctgcatcagggaagctcgcagattgggatttgaaagaaggatcaaaagtttcgaaggacgaaaaaacagcgaaaatcaaaggggaacaaacggttgacgtgaagtcgatcatggacggaacgattgtcaaaaacgaagcgaaggaaggccagatcgtacaagccggtcaaacgcttgcgaaaacaatcgacatggatcatctgtacattactgctaacattgaagaaaacgacctgaaagacatcgaaaaaggggacaaagtcgatatcgtcgttgacggtgattcaggcactacatttgaaggaaatgtcgaagaaatcggctatgcgacaaactcaacatttgacttgctttctcaaagcaattcaagcggaaactacacgaaagtaacgcagaaagtacctgtgaaaatttcaatcaaaaacccgtctgacaaagtgctgccgggaatgaacgcatccgtgaaaatttcaaaataaccgggggaaataaaaacgagcgaaaggaggatgtcataagtggcttctcagaaaaaaggaaatatgtcactgcttatcatattaatggccggcttgtttctggccattttaaaccaaacgctgctgaatgtggcgatgcctcatctcatgacagagttcaatgtgagcgccacaacgattcaatggctgacaaccggatatatgcttgtcaacggcgttttgattcctttatcagcctttctgattatgcggttcggcggacggagcctgtttttaacggccatgctgctgtttacggccggaacgctgatatgcggaatttcgcctaatttctcgacgatgttaaccggacgcctcattcaggcagtcggcggaggcatacttcagcctttggtcatgacgacgattctctttatctttcctccggaaagccgcgggaaaggaatggggatctttggccttgcgatgatgtttgctcctgctgtcggtccgactctatccggctgggtcattgaaaactacagctggcggatcatgttttacagccttgtgccggttggtgtcatcgtcatcattttcggttttttcctatttaaaaatatgacggaacctaaaaaaatcaaattggatacagcaggcgcgattctttcagtcgtcggatttgcggcgttgctgtatggcgtgagcgaagccggctcagacggctgggatgatccgatcgtactttctacagttgtgatcggtgtaatcggcattgccgcttttatcatccagcagttgaaatcgaaagaaccgatgcttgacttcagagtgttcaaatacgatatgttttcactgtcaagcgtgatcaacgccatcattacggttgctttgtatgccggaatgttcctgattccgatttatttgcaaaacctggtcggttttacagcgcttcagtcggggcttcttatgctgccgggcgcactcgtcatgcttgtgatgtcgccgatctcaggaattttatttgataaagtcggcccaaggccgctggcgattgtcggtttattgatcaccgttgtgacgacctacgaatttacgacgcttacgatcgatacgccgtatatgtacatcgtgctgatctatgcgattcgggcgtttgggatgtctatgctgatgatgccgattatgactgccggcatgaaccagcttccgcagcatctaaacagccacggaacggcgatgtcgaatacgcttcgccaaatcagcggttcgatcggaacgagcttgatcacgacgatttatacgaatcgtacgacattccactatgcatcaatggccgatcagacaaatacggctgatccgtcatttatgagcacattgcagtcaacgattcagtcaaccgcgcaatcgatgcatatatctctcgaacaagcacaacaatatgtcgtgaaatatttgaccggacaggcgcagctcaactcgaacgtcatgggtattaatgacgcgtttatgtgggcggccgggttctgtgtcatcggtctcgttctcagcctgtttttgagggatgtcagaaaagacaagctgcgcaggaagaacaaagcgcaggagctgacattgcttccggctcctaaagaagcgaaagaatcttaaaatgaggaggttctgacatgaaaatttatgttgtttacgacagtgaaggcgagcatacgaaaaagctggctgaagccattgcagaaggcgcgggggaacatgatgctgcagacgtgcggatcgatcatgtcagccaggcggatattagaaagctcgaagaaatggacgctatcatctggggatgcccgggccatttcggtacaatcagctccggattaaaaacttggatcgacaggctgggctacctttgggcggaaggaaagctgatcaataagatcggcgcagtcttctgcacaacggcgacgacccacggcggtcttgaggcgacaatgctcaacttaataacaccgatgcttcatcaaggcatgatggtcgtcggcttgcctggaaatgtacctgaaaatgctttatacgggtcttattacggtgcaggcatcacgtgtcctgtcgacagtgacgaattgatcggcgaggaaggcctggagctgggccgggctttaggcagacgcgtcgcccaggtgacagaccgctttacagcaggacagtgaggagcgatttgacatgaccattatactgaccatcatcgctgctgtcctcgtcattatcggtctggtggtatttaatgtgcggtcggcgtcttctcaggataaacccgaacatgaggataaagctgcatctgcggctggcattcctcaggttcaggaagaagaagagcctgagcaggttaaagccgatcagcaagatccgttcgaaatgaatgatcaaacctatcgggcgatcctgcaaaaacttcaacaaccaaaagaggaaaaaaaatatcccgagaagacggaaatggacgatatggattaccgaaacgcattaaaatccatgaaaaaacgggaacaggattaaaggcaaattcgctgggcaccagcgggtttgcttttttatttgcgctttttttgcaatattacttccgattccccccgcactactgatgcagtactctgatacagctcggtctggaagggaagacgcagctttagttataaattcgaacaacaatgcgttattgctgttgtataccaattgatatttcgcgccgtttattcattttcgagctgattgtcagaaacgttctgatccgaagcagcaacagcctgttttccgcgtcatttgcttctcgtcaatatcgctgtctgtttaggctgcgtgtttttttccacatgagtgatgttctttcgaacgatagatgagcgctcagaaaatattcggctatcaaaaaatcatccgggacatttccttgttgatctacgatgcttatggattattcgaggcgctgttcatcaagagcggcttattccagaaagtgcagagattctggagcatttctttaaatgctgatttcaaatttcatgatgaacagccagaaaggagacgaagaacgtctctatttaacagagcttgatatgttctgcgtccatttcgggtcaaggatatattcactattatgaaaccaatttttccgatttccgtataaacaaagcgtggaacctgttaaaggacaagaaaaatcgacagggatataaaaatcggcaagctttccaaagggaaccggggcaggctgaagctagcgctcacattggcgagcgatgcagcggtcgtgctgtttgatgaaccatccggtctccgatggtgagggagtcgacagtcaaaagccttcttacatatttggagcttgacaagcagacaatcgccatcgccacctatgaaattgaacaaatattggatgtcgtcttaaatggccgaattgaagcaaaaaaggatgtcgaacagctgcgcgaggaatccggaatgtcgcttttggaatggctgaaacggtttattaaagaaaaaaattgaaaaagcgggaggagaaacattggaaacacttttggaattaaaaaatgtatcaaaaacgatcagggggaaaaagatcatcgagggcttgagttttgacgtgcgggcaggcgagatattcggcttcctggggccgaacggcgccggaaaaacgacgacgatccggatgattgtcggacatatgagcattaccgccggtgaaatcgccgtgtgcggcgtcagcgtaaaagaaaactttgaaaaggctgcacggcatatcggagcgatcgttgaaaacccggagctttataaatttttaacgggctaccaaaaccttcagcaatacgcgcgcatgacgaaaggcgtgacgaaaaagaaaattgacgaaatcgtcgagctcgtcggattgaaaaacaggatcaacgacaaggtcaaaacgtattcgttaggaatgagacaaaggcttggccttgcccaaagccttttgcacgatccaaagctgttgattctcgatgagccgacgaacgggcttgatccggcaggtatccgggaaatccgtgactatttaagaaagctgacgagagaaaagggaatggcggtcatcgtttcaagccacctgctttcagaaatggagctgatgtgcgacaggatcgccattattcaaaacggaaagctccgggatattcagcatgtgcacggacccgctcgggatgagaagaagcgctattatattcaagcggacgacacccaggctctcacacgggaagcggctgctttcagaaaggtgaaggttgacgaagcggaaggcgggatagagctcagcattcaaaaggatgaagtgcctgatttgattaaacacttgacagacagcggtgttcgcttatatgaagtgaaggctgtgaacaaatcgctggaagaccgattcctggaaatcaccgcagataaggaggaagctcagcatgtttaatctcatcgtaaatgaatggatcaaaatttttaatcgaaaaggcacatacgtcatgatcggaattttgctgttagctgtcatcgggctgggcgttctcacaaagacgatcggagagacagaccaaaacacggactggaaaaaggaattggcgcaggaaaataaggacatgaaggaacagcttaaagggaacagcaatccaacacttgaaaaaaattatgaacagtcgatcgcaattaatgagtatcgaatcaagcacgatttaccggcagatggggattattcagctctgtctttcatcagcgatacgagcgggctcatctcgctcgccggtttgtttgtaatcacggtggcggcgggaatcgttgcgaatgaattcagctggggaacggtgaagctgcttgtcatcaggccgatcagccgctttaaaatcctgctggcaaaatattttacggtcctgcttttcgcattggctttgcttttcattctgttcgcaagcgcagggatcacaggccttgctttattcggggcaggcgacagcagccaggttcacttggtgtatgtcggtggaacggttgaagaaaaaagcctgctattgcatttggccggcagctatttgctgaattcgatttcgcttttgatgatggcgacaatggcctttatgatttcagcggttttcagaaacagctcgctcgccgtaggtatttcgattttccttttggttatgggcggaacggtgacaggcctgctcgcgacgaaatttgcttgggcgaaatacatcctgtttgccaacacggacctcactcaatactttgacggatctccggttgtttcagacatgacgctgggattctcgattgtgatgctggctgtctattttatcgtttttcatgtgctcgcctttgttgtattcacaaagagagacatcgcttcataagcggtatacgtttaaaaaaagcctgacaccggtttccgggcgtcaggctttttttaaatataaaaagactgctgacattcggtcagcagtcctgtatgaagatcagcggttcacagcttacgcttttgttacgttagcagcttgtggtccgcggtttccttcaacgatttcgaaagatacagattggccttcttccaaagttttgaagccttcgccttgaatagcagagaaatgaacgaatacatcgtcttgtccttcaacttcgatgaatccgaaacctttttcagagttaaaccattttactttaccttctagcatgaaatttcctcctaaagcgataacgcttaaattcactattcttgctctaaaacaaacttccaagacgaaaactcttacaaaactttcttcttaaagatagttcgaacaaaaataattacctttactttaccagtgtttaaacgaaattacaactgctaaacacaatttttttaaaaaaagtgaaatttaatgctcagggtgaaaaacaatgagtaaaaagggagtttttgaaattttcacgaatctgattgacaacatttcaaagaagctgtaaagttaggtaaaacttcatgcaactatacttcttattcagagaggcggagggaattggccctgtgaaacctcggcagcgggttctgcatacagcagaatactgtgccacatccaacaagccgtacgggcttggaagataagaagagagcggactcactctatttactttgtgtcgtcaaaggcttcttcttattttttaagaggaagccttttttgttagccctaaaagaggaggagatcatcatgattacatttgaaggcgttgaaaaggtctatgaaagcggcggacagaaggtccatgcgctcaatggaatcgaccttcatgtggataaaggggaaatatacggcgtcatcggcttcagcggcgcaggaaaaagcacgctgatccgctgtgtgaacttccttgaaaaaccgacggccggaaaggttttcgtcggcggaagagacttaatgtccctgtcgaaagctgagatacgaactgtgaaaaggaagatcggcatggtttttcagcattttaacctgttaaattcaaagacgattttcgctaatgtcgctgagccgcttgcgcttgttaaaacaccgaaagccgacataaagaaaaaagtgacggagctgctccgttttgtcggacttgaggataaagcccgcgattatccggatcagctttcgggcggacaaaagcagcgcgtcgggattgcccgggcgctggcgacaaatccggaggttctgctctgtgatgaagcgacatcagcgcttgacccgcagacgaccggcgatattttgaagctgctgaagcgcgtcaatgaacaatataacatcacgattctgttaatcactcatgaaatgaatgtggcaaaagaaatctgcgacaaagttgcggtaattgaaaaaggaagaatcattgaatccggcagtgtgtttgacgtattttccgcgccggaaaccgaaacggccaaaagctttgtcaaatcagccatcgaccacgagatacctgaatcgattcaaaaattaaatctgaagcacctctaccagcttcaatttgtcggcgaatcttctgggaagccttttctttctcaagtgtcaaagcggtatgacgtagaagtcaacattctgcacggaacgattacagagcttcagggaattccgtttggcagcatgacggtcgagctgcagggggaagatggtgaaatcgggcgggcgctcgaatatatacgcagggaaaacattcgcatcagggaggtataagcatgctagttacatatgaccaaatcattgacgcactggttcagacgattcaaatgacggttttttcgcttttattttcaagcgtgatcggcattccgctcggcattttgctggtagtcacaagaaaggggcatctgcttgagaatccggcagtttttacgtttgtcaatatgatcattaacattttccggtccgtcccgtttatcattttaatggttgctttaattccagtgacaaggctgattgtagggacgtcgatcggcacatcggcagcgattgttcccttgactttttatgcggggccttacatcgctagactcgtcgagaactctctgcttgaagtggatccgggagtcattgaagccgctgaagcaatgggagcgactccgagacagatcatcttcaggtttctgattccagaagcgctcggttcgcttgtgctgagttttacggtggcaacggtcggattggtcggggcgtcggcgatggctggtgcgattggtgcaggcggtcttggggatttggcgatcacatacggctatcaaagatttgacacgctgacgatgatcatcacggttgcaattctcgtcatcgtagtgcaaggattgcagacatccggaaacgttctgtcaaaaaaattgagaagaagatagacagagagggagacggctattatgaaaaaatttgcatgtgttgtgatcttcctgctgcttgcggcagtgatcgcggggtgcgcggcagactctgatgcgaaaaccattaaaatcggcatcagcggaacggatacgagaatttgggactttgtgaagaaaaaagccgaaaaagaaggcttaaagcttgaaatcgtcaaatactccgactatgttcagccaaaccaggctttggcgagcggcgacattgacgccaacgcttttcagacgatatcctactttaatgcattcaaaaaggaacgcaaccttgaattatcgccggtcggcacaacgatcatcgctccgatgggcatttattccgagaaatatgattcgcctggcgatataccaaacggcgcggaaattgccgttccaagcgaagcgacgaacatgggcagagccttgcttctgctggagtccgccggcctgcttcaattaaaggacggatttgacggaaatggaacgcttgatgcaattaaagaaaatcctaaaaaactcaaaatcacaacggtggccgcagagcaaacgccgcgcgtgcttgccgatgtcgctgcatccgtcatcaacaacggcatagcggttgacgccggcttccatcctgtcaaagattcgatcaaactggaagatgaaacagcgacaccgtacatcaacattattgcggccagaacagaagaccgggatcgcgaagatttgaaaaagatcgtcgagctgtatcaagcagacgacactgctgaattgattaaaaaagaatttgacggagcacagctgccgactttcgttcctctaaaagacatcggcgaataaaatgtcagtcgcgcaattgcttcccgggtcatatattgaaatacatcgataattcctacttgaccaatcaggtttgttgtactatagtttttaaatgtaaaaaattctgggggtgcttttgttatcatgacattatttgttgttattaatattatcgtcatgctcggcctgatggcgctcctttatatgatgcaaaaaaagcatgtttctttttctaagcgggtatttaccgctctgggaatcggaattgtttttggattcgctttgcattttatatatggttcgtcttcagaaacgattacgcagacttctgattggtttaatatcgcaggcggcggctatgtcaagcttttgcagatgatcgttatgccgcttgtattcatctcgattttgggtgcttttacaaagcttaagctgacgcacaatatcggaaaaatcagcggattgatcatcgggctcttaatcgcgacgacagccgtcgctgctgcggtgggtatcgcgtccgcgcttgctttcgacctgcaggccgtccatgtggaccaaggccaggcggagacaatgagaggggcggaactcgaacagaaatcgcaggacatggaagccaaaacgcttccgcagcaaattgtcgagcttcttcctggaaatccgtttttagactttactggagcaagaccgacatcaacgatcgcagttgttatttttgcggctttccttgggatcgcttatctcggggtcaaccgaaaacagcctgaacaagctgaacttttcaaaaaaatggttgatgccgtgtatgcgatcattatgcgtgtggtcaccttaattctgaggttgacgccttacggtgtattggcgatcatgacaaaaacgattgcaacgagcgacctcgacagcattgccaaactcggcaaatttgtcatcgcttcatatgcggcgctgatcgtcatgttcatcattcacctgctgctcattacattcagcggtttaaatcctgtcacatacttgaaaaaggcgtttccagttcttgtattcgcgtttacatcaagatcaagcgcaggcgctttgccgctgaacattaaaacgcagcgaagccttggtgttccagaaggcattgcgaactttgccggatccttcggactgtccatcggtcaaaacggatgtgccggcatttaccctgcaatgctcgcgatcatgatcgcgccgactgtcggccaaaatccgcttgatccgtcattcttgttcacggttatcgcagttgttgcgatcagctctttcggagtggcaggcgtcggcggaggtgcgacctttgcagcgcttctcgtcctttcggcattaaacatgcctgtagcgcttgccggacttctgatttctgttgagccgctgatcgacatggggcgtacggctctcaatgtcagcggcagcatgacgtcaggacttgtcacgagcaaagtgacaaatgagcttgaaaaagacacgtaccaagaccgtacaaatatcattgaagcagaagtgtaaaagaaaaacggcccgcacagcttgagagctcgtgcgggccgttttttatgaatagctttgatcgtcatcgaacatcgtctgagctgcagcctgatcgttcataacattcaccggagcagtcatatggcttgattgatgctggtcatttgccgtatggcctgactggcggtgttcatgtgattgtcctcccggattaaaagcctgcttgatcatgtcagccggattcatcatcgtctgattgcggccgcttccttgctgccgtcctctcatgccattcgcgaacatgccggtcaatcttttgcggatttcgggagaaaaagccgcggttaatgcagctgatcctaaaactaatacagcgggatggatgccagatcttcttctaaacaaagggtcaacctcctttttacgtataccatccccagtcatgatcggttttattcttcaaccttggccgcgtgatataagcggtgcttttcaaaaaattcgaaaatggcgcggtagactttcattttattttcttttttggaaaaaccgtgcccttctttttccaaaacgagatactcgatattccgctccatgttcctcaactgatcgacgacctgatcggactcttcctttacgacgcgcggatcgtttgcgccttggatgatcagcatcggctgagtcatattctccagatatgtaacaggagaatcggctttcattttttcataatcccgctccggattgccgacccatttttccatcatcggctgccagaaatcaggtacggttttgacgaacgaaaacaggttgctgactccgcatatatcgacgacggcgcggaaatactcaggatgcctcccgtggagcaaaagcgacatatatcctccatagctgccgcccattaaaaagagtttttcgcggtctgcaagcttttgatcgataagccagtcgatgcccgcggtcatatcgaggcgcggcccgtctccccaatcttgttcaaccattttaaagaatgaataaccgtaattcgctgatcccctgaaattaggagcgaataactggtaacccatttttgcagcgagttgaaagagatcgtagaacataaaggtttctgcatcttgcggtccgccgtgcggccaaataatcgtccagccgttcgcttctaccggggagggcttaaacagcagtccttctattggcaggccatcaaaagaaggatatgtcacaacttcaggataagacagctcctgttcggagaaacccggaaccgaatgtttcgttaattgccgccattttgactgtcctttcgttaatacgtagagattagtcggcctggtcggcgttgagccgagaatgtacagcgtaccagaataggcgcagtgtattttcgaaatggatgtgcaagggcaatcgatctgccggctttgccccgttgctgtgttgtactcatacatcacctctttgacacctttttttccaatgagataaaggaaagttccattcgggtcagcgtggatggatgttaaatcagttttatcaatcgaaagcaccggcgtaaaaataccggatgaaacagtgtacaaggcaagatatgagaactcggcttcgtagtttgtcgtgacgaataaccgatcatcagatgcaaaatgggaagaataaaccatgtgaggcagcgtctcatccgggaagattcctgtcgtcacgccttcagctgtatggaccatacagacagaatggctgttgacatagtagacatgtatgctgacggctttctcgcccgggcttacatcagacagcattgaagttccgtcttttccttcaaaaataagctcttctttttcagtgagacaatcatatctgtatgtatttaaaaatgtcggattgtcctttgtagaggagtagtaaactgcgttttgcacagggatgggggcgaagtggcggtctgtttgatttccgtttaatgattggaacgtcccgttttttaaagaaagcttgtacagtccgctttgttcgtttccgtcattgtcaaaaccagcataaaggattgagccgtcgggattgtaggcaattccttttgagtcctgattcaagaatgacagctggtacgggtatgtatcgggaagatccatcgcccacaggttcgatgttccgttgaggtttgtatcaaaaataagctgagtctcatcgggatgtaccgcaaagtctttaatgcgcagcgcatgcaaaatgctatccgctttttccatttcatatacacctccggatttatttggatattttttcgtccgttatgatcataacaaaataagcgtataaaaaatatattttagacaaataaataacacgaaaaagaaaaaaactatacgtaaatcattaaaggaggcaattttaatgttcaatatgaaaaaaggcgcgattgctgctttgctccttccgctgctgttcacagccggatgcggcatggcaaaccaaggggcagataacaaccggcgcaatcaggacaatgcgcttcaaaatgtaacaaacagagataacgacgctacgaatgtcaatgacggcagaaatgtcaatgaccgaatgaatgtgacagacaaccgcgatgccaatcgtgaagacaataatatggaagtggcggataaagccgcagataaagtggcggaacttaaagaagtcagtagtgcaaacgtgattacgacaaaccgcaacgcttatgtcgcggtcgttttgaaaggcaatccgaaaggcaacttgacgaatgagctgaaagggaaaatctcgaaaaaggttaaagaaacagacaataacatcaacaatgtgttcgtttcggcaaaccctgactttgttgaccggatgagaaactatggcgacagaattcaaaatggcgaaccgatcgaaggactttttgaagaatttggtgaaacgatcaacagaatttttccgaatcaaagataatgaaaagccgcaatccgcggctttttttattggctgctttcagacagggcacttcctgaatcatcccgcatagagtgtagtacagaaaagtatgatgcggatggagggataataagtgacgggggagatgaaagcagcctttgttttaatcatggcgggcgctctatccgctctgttattggccatttttgtcgtgttcagccaagagagccctgaggcggctgtgctttcgggaaaaaaagaaaaactgaaagaatcgctggaaatggtcaaatatgaaagtgtcagcatttattacgctgaaaaagataggccgattctggagctgacaaaggagacgcttcgggatgccgctgatatgaatcgggaactgtttgtcagtcctcttcaagacagcgttgatttgatctttttttcaaaccgcgatgatatggagtcattttcaaaattaaaggatataaccggattttattcaaacgatatgaggatgatcgggcttttgcccgaggagaggaagcatctgaataacggcgagggattcgccgtcttcctgtacaaacgggtgctggtgcatgagtatacccattatgcttttcacgtcaagctgagagaactgaatgccgacccgggaacttatccgctctggtttcacgaaggagtagctgaatgggcttctgctcatgacgcgatagaaatccggactttgccttcagtcgtccccttgagcaagctgaagaccgaccggcaatggcaaaaagcccggactggatatgaaaccgatatttatttgcaaagttattatttgatcgaagagcttgcggagaaaaaaggaaggggcgtcatcctcgacattatcgaggaaacggctgagcggggaagttttgcagacggatttaaggccgccgtcggccagtcgttgacaggttttgagaaagaatttaaacgaaaatacgaagcgaaaaaaacggcgttgaagtttcatcttcaatgccgttttcatgatcaatgaataggtctctgctgcccgcttggaggcatttgcggctgaccttgcaccggagcgaatgctgaagtcatcttctgcatgtcttgcggcgcaagctgaggaacttgatagtacccgtgtttgttttgataaaggaaaatttcataagccatttcgatatagtgaggaatctggtctgccagaacccttctgcagacagggtttgtcacttcgggagccgccatggccagcgacgaacaacaagttttcatcaagccgagcataaagctgctgatgcaggcgtcatcaatagcctgcacagattgcttcggttgtttcggctgggcatcttttaaaccgtagacgaatttgcggtcctctttcatcatatacgttgccgtttcctgactcggcttttgccccgttctgaaacattctgtcgtaatgttgtactgagacgaaataaaccgatgctgcctgtccaaaatgtcgagcagctccggatctttgacatgctccctgaacatcatatactgctcaaggacgccgatcattccggacagcacttcatgcatgtcgaacacttcgtgccccccgtgattcatatgctgcataccttcattgccttgattgatctgcatttgcggctggttttgctgttccactctaacgtatcctccttaaatgtaattcaactattatatttcgtttttgccgctatgtttattcaaaaaaggaataatcgataatctggatttaaagggattttattctaaccgtcgaatagtttagttcagaagaaaatattatgggggtcttgtattcaagacagcacatcatatcattggtcgaaaatggggataacggtcatcttggcgccaaactgagtattaggagaggaaattcaggccgattttgaaatccctcgcacctttgtaaacggagcacaatctgccgggcgatgatgaaaagttcacgcgtgtttccggcagtttagaggaattcggtgagtatatggatatctgatatccgaaaaacaatagggccggaacatggccggattcaaataaaggctgccggaagaataaaagacaatgtcggtctgtgtgctcatgcaccttttgttcagaaacgaccgaaaaacaattgaatagcaatgcccggctcgatatcggcatgaaagcatctggcttctaatgcctgcaactttttattgcccctgcgtgatctgtaaaggattctccctccgtaaacgatttcagctgccaatcatcatgaaatgcaaaaaaggtgttttcctttttgattttgcacttagaaaaggaggagttttataatgctgggctcaagtgagacggttggaaaaaagtcaggtttatttggtaatgattctgtgtatccaaaggtgcaaacagaagtatataaaaaaatcaatgaactgagtggttttcataggctggatgatatttatctttccttgatcgacaagtatatgtttccttgtctgatcctgaatgaccggggagaaattgtcgcgtcctcggaaagtgctgatcaatatttgaaaagctcaaaaggcagcattcatcaggtttttcccgcgagcttatccgtacaggtcaatgccgcgttacagcgggcgaagaaagagaaaaaagaagtatcgtttaaaaacgtcccgatttatttaagcggagaactatcctttgttcatttgagattaaaatgtttcttccgccagtatcacaagctttatgtgctgtttatcgaaaaagcacaagaaggggcagccaacgcgccggtatccggcggagaggacggccagcttcatctgcaacatctgtaccggacggtaaaagagctcgaagcgtccaacgatgctttagtgtccgcaaatcaaaagctgcaggaggaaaacagaaaattgacggcgctcaacagggcgtttgaaaagaaagtgaacgagctgaacacccttaaaaatgatatgaacaatctgctgaccagcacgaacatcgccgcagtttttttggatcaggaattgaaattgaaattatttactccagaagccgccaatatgttcgacctgaaaaacgaggacctttcaagacctgccgataagctgacagagaggtttaagtatgaagggtatgccgatgacttaaggcgcacgctatatgaaaacaagacggtcgtaaaagagtttgaaatgccagacggcggctggtatgccgtaaaaatgatcccttattatacatcgggaaacatggttgaaggcattgttgtcacattcacgaatgtcactgagctgaaaatgacaaacgaggcgctgcatatcagctcacaagctatagatcaaagtccggccaacatattgatcacttcggtcgacggttcggtcacttatgcaaacaaacgcttttgccggatgttcggaaaacatcaggatgacatcatcggcggcaatgtgtttgatatttaccgcaagcattttcactgtgaggatctcactcgcttctggaaacgcgtccttgaaaagaaaccatggtcaggagaacttaattaccaggatgaggagcagcaggacaggtgggagcaaatctcccttgttcctgttgaggacagcgcggggaacgttcagcaggttatgctgatatccgaggacattacaaaccaaaagcgatctgaaaaaatgctcatgaaatcggaaatgctgtcggcggtcggccagctagctgccggaatcgctcatgaaatacggaacccgctcacttctctgaaagggtttctccagctgatgatccaatccaaaaaatatcaaaaagactatgcggaagtgatgatgtccgaattcatcaggcttgaagcaatcatcaacgaatttctcgtattggccaaaacgaaatcgaatacatttgatccggttcaggtcaactcgattgttgaagatgtctgcatggtattggagtcgcaggccgtgctgaacaacgtaaggatcgagaaacagctgagcggagatctacctgagattctcgctgtttcaaatgagctgaaacaggttttcatcaacatattaaaaaatgcaatcgaggcgatggaggatgctgaaggctttattacgatacgttcctattttgaaaaagacagcgtattcatcacctttgaagatcagggaaagggcatctcaaaagaagtgctagaaaagcttggggagccattttatacaacgaaggaaaaaggaaccggtctcggattaatggttacatttaaaattattgaaaatcacggcggaagcattcatttcgaaagcgaagaaggaaaaggaacgatcgtaaaattgaagcttccgattaaagaatgagaatgcggtcatccctattctcattcttttttgaaatttttacaaaaaaatcatatagcctttataatcatcagataaatttgacaggaagcaaaaaacgggaggcgaatatatggtcaatgttgtaaagagccgttttatggctggtttgacaatcacgtttatgatgattgcgtcttttttgacgccgtttgcggacgtaacgcacgcttcagaaacgatttcagtagaagaagccattaagcataacgaagggcatgcagccgttgaaggctatgtcgtcgggcacacaatatcgagcggccattatcgtttcagcggaaatttcgctaacgattataacgtcgcaatcgctgataaaaaggaggaaacatcacctgagaacatactccccgtgcagatacccgcacctttcagagaccagttcggtttaaagacaaaccctcatctcatcggaaaaaaactcatcatcgaaggcgaacgcactacatattttaattccccgggtttgaaatctgttcaatccatcacattttccggagacgatgcaccgtctgcccagccggagaccaaaacgatagccgaagcgcgcaagcttttaaatgaaacggtcaaaatcaaaggaatcgtcactgccgatcaggcggctgtcggaggaggaaagctgtccacatttatccaggacgatacggcgggaatcaatatctattccgctgcgcaaggcgattttccggaactaaaagagggtatgtctgtttcggtcacggggaaaatcacgacatacaaaggcttgacagaaatcgtacccgcaccgtcaggcattgaagtaaccggagaaggggcggcactgcccgaccctgttccgctgactattaaagatgtgctcgatcagggaaccgcagctgaatacgaaggccggcttgtgaggatgaaaggctttattgaaacaaagccggatgcgccggcaggcggcggctataatatcacaatgatcgatgaaaactatcatccgctcacactaagggtgatggaacaaacgaatgccgccgcttcgatagaacaaggacaatggtacgagattaccggcatattaagccgctatgattcggtgcagcttctgccgagaaaacaggaggatcttcggaaattagacggcgccgcgcatcctccccccgctgctgaaggggaatacgaaagcgttgtggaacgagtcgtcgacggggatacgatccacttaaaagagcctgttctcggatctacaaaagtccgctatgtcaacatagatacagccgaaacttatcataagccgaaaaatgaattagatgaaaaccagctgcagcacggaaacaaggcgaaggaatatttgcagtcgatattggccccgggagacaaagtcaccgtgaaagtgggcaaggaagcaaaagacagctacggccgcctgcttgcccaagtcatcactgaagacggcgtcaatacgaatttgcagcttgtccaaaaggggatggctgtaacctacttcatttggccggttggaagtgatgaagactatcaattgtttcaaaacgccgtcaaaaaggcgaaaggcgataaaatcggcatttggaatcccgctgatccgctcctcgaaatgccgtttgaatttcgcgccagggagcaaggcaaagggctgacgcggcatgtcggagactctgcggaaaatacgtatgtcgcgcctgaaaagtggcgggagattccggtggaaagacgaattttctttgcgtcggctgaagaagcggaagctgcgggctattcgaaaaaagagcaaagcggcaatattccgctgcgcctgttaagcatgaatgatctgcacggaaagatcgatcagcaatatcagctcgatctaaacggcgatggccggacggatggaacattcggcaggatggattatgcagcatcattgatcaaagagaaaaaagccgagcaggaaaacacgctgatcgtccacgcaggcgatatgatcggaggaagctcgccggtttcttccctgcttcaggacgagccgacagttgaagtcatggaggaaatcggatttgatgtaggaaccgtcgggaaccatgagtttgatgaagggaccgaagagctgctgcgcatgttgaacggaggcgaacaccctgaaggcaaagggacaaaaggttacgacggacaggatttcccgcttgtctgcgccaattgcaagttgaaggcaagcggggacagctttcttcctccatatgaaattattgaagttgaaggagtgcctgtcgcttttatcggcgttgtgacacaggcggccgccaatatggtcatgccagaaggaattcgctcaattgaatttacagatgaagcaaaggccgtcaaccaggctgcaaaagaactgagagcgaaaggtatccgggcaatagcggtgctcgcccatatgacagcttcacaggacggcggggttgtgaccggcgaatcagccgaacttgctaaaaaagcagatcccgagatcgatgtcatctttgccggccacaatcatgaagtggtcaacggccaagtcaatgatattttaatcgttcaagcatacgaatacgggaaggcaatcggtgtcgtcgatcttgaaatcgaccgggaaacgaaagacatcgttcacaagaaagcggaaatcgaatatgtgaatcaggaaaatctcaagcccgatccggcggtcggtcagatactggataaatatgagcggatggttgcgccgatcatcagcgagaaagtcggtgaggctgcgcacgatatggccggcggctattcaaatgacggagacacccctctcgggaatctgattgctgacggtatgcggcaagcgatgaattcagatttcgcattaatgaacgggggcggcatccgccaagatttaaaaaaaggaacgattacatggggagacttgttcaatatccagcctttcggcaatgtactcgtccggcttgaaattaaaggcagggatttatacgatattatagacgcgcaaatatccccatcttacggcccggattactcgatcagcggcttcgcttatacatgggacccgaaaacaaataaaaccgcggctatttttcttgaagacggaacaccgattgatttagaccaaacatatacgctgaccgtaaacaactttatggcatctgcttcaggaagcaagtatttgccgatttccaggcttggaaaaaatccggtcacaggtccggaagatatcgaagccacagtcaaatttgtcaaaagctttaaaaaaccgatcgcttatactgccgaagggcgaatcaaaaaattagcagaagatgattcgcgtccgggagaacagcccggacgcggggctgatccagatgacaaagaaaaacccggaagcggaggcgctgatccgaatgacgaagaaaaaccgtctggtgataagggcgatggggggaaacccggcaatgacaccggagaaagtccggttcatgacggtaccggcaatgcttcaaggagcggcgctattcctgttgcgggcatgacgaccggtgaaggatcagatgcgcctgcggagaagatggacggtctgtcaaatgatgcgtttctgccagacgagcgtgaagagcgcaagctacccgatacggcggcagcttacggcggtttccttttatacggcttcctgacgtttatgttcggagcgattctttatatgcggaaaaggggtattgcgagactatgaaagtcaagatgttatcgtttctgctgatgatagcggggcttgccacttttgcatacggcggctggaaaatattcgatatgaacagacagacggatctttctttaactgaagcaaaagaagccattgcatcgagtcaatccgcccgttcggctaagcacccatcggcgcccgcttcatttaagcccgccgccggcgaagcggcaggcatactccatattcccaaactgggcgcagagcttcccatcgttgaagggaccagtcccgatgatttggaaaaaggcgtcggtcattataaaggcagctattatccaaaacaaaacgggcaaattgttctttcaggccacagggatacggtttttcgcagaacaggggagctggaaatcggagataagctgaaaatcgagcttccatacggaagcttcgaatatgaaatcacacacacgaaaattgttgaccaaagtgacacgtccatcatcacgctgcagcgtgaaaaagaagagctgctgttaacgacatgctatccgttttcttatatcggaaatgcgcctgagcgctatattatttatgcaaagccgctgaaaggatgacaaaatcccaaaacaaaaagccgttttgggattttgtcaacaatctgtaaggctgtcccatcgaggacagcttttttaccgtttaatcaaccgtgccgaacagtcgtccgatttcgtcttttaaatcatccggaagcggtgccgcgacagtgacacgttcttttgtgatcggatgggtgacattgatctcgattgcgtgaagagcctgtctctgaaaaagcccctttgaaccgccgtataaggtgtcgcctgacaaaggatgaccgatgcttgcaaggtgaacgcgtatttggtgggttcggcctgtctccagctgaagtctgcacagtgtaacatcgtgacggctgtcatatcctttcgattcaaaatgggtgacagcgggctgtccggaatgggacacccttcttctgacggggtggtgcttgtctctgccgattggcgccgaaatggttcccgttttttttctgaatttcccttccgctacggctacatatgtccgcgccagttcttttctttgcagctgttcgtctaaaagcgcgtgggcgaggcggtgctttgcaaaaacgacagcgccgctcgtatccttgtccagacggtggacgtgccggacttttcgctcctccccgttcatttgaaaataaaacgccacaaggttgctcagcgtgccggtctggccggcttcattcggatgagtcgccattcccgccggcttattgacaataagcatgtgatcatcttcaaacaggacgggaagttccccgtattcagggacgattccgctttcttcctcctctctgagatcgatcatcacgctgtctccgctctccagccgaacgttatgattcaccgatttatgattcactttaactttctcgtttgcgatccagtattgaatgacaggcttcgatgctttcgcctctctttttaaatatgcatataaaagttcgccgtgatgccgtatgtctgcactgaagaataagccgtgatttttttggttcatttttactgctcctttctgtaaaaagcgttcaggaattaggaaacacttacctccacagcccattgtttatgtatgctattctgtttgaagagatttgaacaagggatgaagggtgatcgatttgcgaattgtaaaggcagcaactgaagaacaagaaatttatatcgaagagcttgtatcagagctgtatcaaatatttccattgtacttgaataaacaaaaaataaaagaactcaaaaagcagggcgcgcttcaattgaaagaggatgaatacaaaggaacgctcgatgaagcgtttcagattatgacaagcctgcaattgatccatgcattattaactaaggcgaagcgcaagtgggtgctcaaagaccgtgatctgttcgataaaaatagccgcaagctgaatgactgcggtctgtacttccctctaacatctgccgactttcatatcgtgaataccgagaataaaatgctgatgtaaaaagccggctaactgaagtgaaagagcttgttccaaatcggaaaaagctcttctttttatgaaaagatgatataagaaaaaagcggaaaacacaatgaaatggtgccaacttcctttttagcatgtgcatgacctgtacatactaacaaccgaaaggggtgcagtctattgacgacaatcagcaatgcgatgtctagacaagtggcgacaatttcttccaatcaaacggttcaagaagcggctgagttgatgagccgccataatgtaggtgcgattccggtcgtagatcaaggcgtattaaaaggcatgatcacagaccgtgatatcacgctcagaacgacagcggaaggccaggacggacagacacctgtttcaaacgtcatgacaacaaatgttgtttcaggaaatccgaacatgagccttgaagaagcatcacagctgatggctcaaagccaaatccgccgtctcccgatcgtcgaaaacaaccatttagtcggcattttggcgctcggggatctggcggtaaacgaattgtccaatgaatctgccggacaggcgcttgcgaacatttccactccggcacggactcagtaagaacggaagagcttgcctcttacagcaggctcttcttcatttatacataccggtttttagtgtcttctcttttcaaggagcggcaagaaggatacaatgaatggtgcaaacagtcaaaaggagttgggctaaagcgcaatgattaaagcagtgatttttgattttgacggtcttattttagatacagaaacgcacgaatatgaagtgctccaggaaatttttgaagagcacggctcagagctgccaatgtcggtttggggaaatgtcatcggcacggccgccggattccagccgttttcttatctggaggaacagctgcaaaaaaaactggaccatgaacaactaacgaaattgagacaagagcgttttacgaaaagaatggaaaatgaaaaagcgcgcccaggtgtggaagcttatttgtccgcggcgaaagagctcggtttaaaaatcgggctggcgtcaagctcagattataaatgggtgtcccagcatttaaaacaaatcggtctgtacgatgatttcgaatgcatcagaacggccgatgatgttgaggaagtcaaaccgaacccggaactctatttgaaagcggcggaatgcctcggtgtgaagcctgaggagtgcattgcattcgaagactctgtcaacggatcaatcgccgcgaaaagagccggaatgaaatgtgtcattgtaccgaataaagtaacgaaaagcctgctgttcgagcattatgaccaccgcctggaatcaatggcggaaatggagctggaacagctgatcgaaaaaatctccgatccatcataaaagccagaggaggaatgggacgtgtccgaaaaactggatctttcccgctttgaaaaaaagatcgtcatccgcaatattgaagaaaaagatatcgacagcatcatcgggcttcaagagctttgttttccgggaatgatcccatggaaacgggagcatctggaaagccatttggaacacttcccggaaggccagttttgcgcagagcttgacggagaagtgatcggttcctgttcaagcctgttgatcaactttgatgaatatgacgacagacatacatggcaggatattacagacgacgggtatattacgaatcacaatcccgacggcttaaacatgtacggcatcgaggtcatggttcatcctgaatacagacggatgaagatcggccaccgtctctatgaagcgcgaaaagatctggcaaggcgcttgaatttaaagagcattatcatcggcggcagaattccgaactatcataagtacgcttccgagatgacgccgagggagtatgtcgaacaggtcatccaccaccagatatatgatccggtcctttcgttccagctgctgaacggattcaccatgatgcggatcaacccgaactatctcccggatgacagagcatcaagcaaatatgcgacattgatggagtggaataatgtcgactacttgccgcagacgaagcgctattacaaatcagcttttccggtgagaatatgcgtgattcaatatgaaatgaagcagatccattccttcgaggagttcgccaaccaagtcgaatactatgcagatgtggcttcagacgcaggagcggattttgccgtctatccggaaatctttacgacgcagctgatgtcgtttctggaagagcgctcaccgagcctggccgttcagcggattaccgaatatacagaagactatatcagcctgttcacagaccttgccgttaaatacaatgtcaacattatcggcggttcccacttcgttgaagaagaaggaaagatctacaatatcgcttacttgttcagaagggacggaaccatcgaaaagcaatataagctccatattaccccgaatgaacgaaaatggtggggcatcagcaggggggacgaagtgcgcgtctttgacacagactgcggcaaaatcgcgatccagatctgctatgacatcgagtttccggagctaggcagaatcgcaaccgaaaaaggggccaagattatttttacccctttctgcacggaagaccgccaaggctatttgcgagtcaggtactgcgctcaagcaagagcggttgaaaaccaggtgtacacggttatttccggaacggtcggcaatctgccgcaaaccgaaaatatggatattcaatacgcgcaatccgcgattttcgctccttcagattttgaatttgcaagggatggaatcgtcggcgaatgcaatccgaacattgagatggtggtcatcggcgatgtcgacctggaaattctcagaagacagcggcaggacggaacggtccggcagctcaaggacagacgccatgacatctacaggattcattataaaaaatagcagattcgggtgccggccgcttgaggccggctttttcctgttgactttcagctttatttttcatatattgtaactattaaaaggaggtggaaaagatgaatcaaactggtaagcgcatgacggatatgcaagcccatctgtatatttgtcgcgcgattttttccggggaatgcgtattacgggatcagtctgcccttttttacacattcaattggaaaaaataccagtgagagacatctgcccacaatcggattttctgatgctgacggcggggtgtaagctctgccgtctttttaatgctcggtgtctcttcacgggatgcggaggaaagatggatgattatatgcagtttgcaacatgtcggtcaaacttacggaggacatacgattttcaacgggctgtcatgggacctgcaccaaggggagcgcgtcggtctgatcggacgaaatggggaagggaaaacgacgttgttgaagctgatcagcggccaaatgaaacctgatgaaggtcttgtgacatggaaaaaaggattatcaacagggctcttggagcagaatcccgcatgggacggcagcaaaacggtaaaagagctgctgtatgatgttttttcatcattatggaacacacagcagaagctttcccgaatcgaacgtcaattggcggttgaaaaggacgcggaaaaactcagattccttttggaaaagtacggggctttgcaggatgaatttcagcgaaaaggcggctacggcatcagcgcgcaaatcgaacgggtggcgcacggcttgaatatcgagcggctattcaatgccgagtggcgggagttaagcggaggcgaacggacgaaagcgggtcttgcaaggcttctcctgtcagctccggatctgcttttgctggatgagccgacaaaccatttggatttaacatcgatcgaatggctgccgtcttttttaaagcagtacaaaggtactgcggtcattgtgtcgcatgatcgctatttcctggatgaatcggttacttcgattctcgaaatcgaccaaggagagcttcacttttcaaaaggcggctatacacactatgctgatgaacgggaagagcgccttatgagagaatttcatgactatcaggatcagcagaagaaaatcaaaaaaatgaaggaaacaatcaagcggctgaaggaatgggcgaatcgcgccaatcctccgaatgacggcctgcaccgaagagcgaaaagtatggaaaaagctttggagcgcatggagaaggtgaaaaaacccgttctggaacgcaaaaagatcgacttagttttcagcatggatgaacgaagcggaaaagatgttgtcaggcttgaggatgtctgcaaaagcttcggtgagcggcagctttttgacaatctcagtatgcatgtccgttttcaggagcgcgccgccatcgtcggagagaacggcagcggcaaaacgacgctgctcaacatcatcagcggaaaggaaacgccggacagcggtgacgtgcagcttggcagcaatttatcggccgcatatctgactcagcatgtcggtgaaatggaggaagagcgcaccgttttagccgaattccgtgaacatgtttctgcatcagaaggcgaagccagaatgatgcttgcaaagtttttgtttttcggccaatccgtcttccgaaaagtgaaagatttaagcggaggcgaacggatgcggcttcgcttggcacagctcgttcaccaaaatcataatgtgctgatcctcgatgagccgacaaaccatttggacatcgaatctaaggagatgcttgaagaagcattaagccaatttcaagggacgattattgcggtttcgcatgacaggtactttcttgaccggcttttcaatgtcatctggtggcttgacggcagaaaactcgtcaagtatgaaggaaactatacattcgcaagggagaagcggcagcagggttgacacatttttatcacatttgataagatgttgctacagttatagaagacaaaagcaatggaatgtatgcacgaactgtatatattctctttcaatattttaattctgcttgattttgttgtatgggtatgcatacaagttaggcagcattcgaacgcctgttgacacaggttatttgagtgctgcctttttttattgtctttctgccataactgtgagaaaagaagggataatggaggggtttagttagtatggcttttcgaaaaccggatgaaatagcgaatgcagcaattgaagcagggatgaaaaaagtacagctcccgctgccgtctctgcttgtattggggtttttaggcggcgcatttatcgcgcttggttatttgcttgatatcagggtaatcggcgacctgccgaaagaatggggaagcctgtccagcctgatcggagctgccgtatttcctgtcggtctgatactggtggtgctcgctggcgctgaattgatcacagggaatatgatgtccgttgcgatggctttattttcaagaaaaatatcactaaaacaattggcggttaactggggaatcgtcacgattatgaacttaatcggcgcactgtttgttgcttactttttcggacatttggttggattgactgaaacaggcccttatttagaaaaaacgatcgccgttgcacaaggaaaactagatatgagcttcggcaaggttctcatttccggcatcggctgtaactggcttgtatgtcttgcggtatggctttctttcggcgcacaagacggagcagggaaaatccttggcatctggttcccaattatggcgtttgtggccatcggatttcagcacgttgtcgccaacatgtttgtgattcccgcagccatttttgcaggctcattcacctgggggcagtttatcggaaacatcattcctgcttttatcggcaatgtcatcggcggagcggtgtttgtcggtctcatttattttattgcatatcctaagaaagaccgctccagaaaagaaatgaagcaggtatcatgaacaaagggcaaatccgctcgataaaacataaaaacgccatttttataaaaagatgattaaaaatagaaattggcggtatgtcccgcaggcagtagaggcattggtgtcttcttttgtctgcggtttttatttgcctgcggcagcttcggttgaagcggatttgagaggggctgagcgatatgatgattaacaaacggtttaaaaatccgtaagaattcgaaccgagatcagctacagtacgactgatccggaaagtggaggggtttttacttagaccaccgaacaacggatatggacattcgccgatgcctatgtcccgcctggaaatgcccatgatttctgtgccctgtcttgaccggttggatcaccaaattgctcctcacagccgcatgccagaacatgaagtagattgcatttacctagccaagcggagttaggtatgtgggagctcttactgtatttaaaatccgatgaatacctagagaaacaccgttgaaaacaaacgggtttttctatatgattgatagtattaatgagaacggttatacataaaaagaaggtgcatcatggagtttctgtttgttttactgccggttttcgggatatttgcgatcgggttcatcggacaaaagctgcttcattttgatattcagaacctatcgaaaatgtccctgtatttaatgtctccgtttttagcgtttgatacgttttatgagaacaagctgacgatggattatatttatatgtctgtctattgtctcggcctctgtttaactttgattctatttgtctacctcatttcatatgttcacggatattccaatcaggagcggtgcgctctcgttttatcatccgctttcatgaataacggaaactacggaactcccgtcgtcctgcttgtctacggcacggccgggcttgatatcgccgttgtgctgatggttcttcagcagcttgtcatgagcacgattggcatgtattacgcagcgaaaggaagcccagaagcgggcggatttaaaatcgtgatgacgagggttatccggatgccggtcgcatacggtgcgctgctcggcatatgctttcagctggggcatatttcgattcccgaacagttaatgacaggaattaaattggtgggagatgccgcgattccgacgattatgattattctcggcatgcagcttgcggtgatttcctttcaacatatcgaataccggaaaatttcttactcgcttttgctgaaattattcgtgtctccgctcattgccctggggtttgcgctgattcttccggtcgacgggctggtcaaacagatcatggtgttggcggcggccatgccgacggcggcgaacacgactttgatggccgtacagtttgaaacaaagccggaaatcgtttcaagcgcgacttttatcagtacaatgctcagcatcgccacccttccggtggtgctgtggctgctttcattatggggctgacctgaatttttctttcaggcggccttttttctggcgataacaaagggaagcttgcaccgcttaaaaaacggcggctgatgacaagggaagccgccgtttcctgagtttacccgtctatttgcaatgcgatatttccaaactgctccccgtctttcatccgtttaaaggccggaaccgcttctgataaaggaaatacttgatcgatcaccggcttaagggaatggcgttcgataaaatcaatcatttgccgaaattcttcgaggctgcccatcgaagtgccgatgatgctgatctgcgggaaaaagagcgagcgcagcggaagctggatactttctccagagctggcaccgaaaatgacgatccttccgttcggtttaatgacatcgaaataatttgcaaaagtggcgggaccgatgctgtcgagaattaaatcgacccgttccccatccaagctttccttccacaggccgcggctgtcaattgcgaagtccgccccatagcggagcgcttcttttcttttttcttcgcttcgggaggttacaatcacccgcgcgcccgcggcctttgccatgagcagcgcatttgtggcgacgcctccgccggctcccggtatgagaatgtgttcgcctttttctaaatgtcctttcgtaaataaagccctgtaagcggtcagagcggataaaggcaggacgcctgcttcctcccaggaaaggtgcgccggctttttcaacacgtgcttcgccgggacgatgacatgctctgcgaaagtcccgtcagaggggccgccgagaatgtccggcacttgcggaacggaatccgtatattcccagccgatgctcggattgatgatcacctctgtatgaacggcgaggtcccgaacgccttcacctgtctcttcgatcatacctgctccgtcggatccgggaataaacggggcatcgcctgcctttctggactgaaaaaggaacaagtcgcggtggttcagcccggctgctttcagcctgattttgacttcaccggggccgggcgttttgtcggaaacgtctgtatatttcagccctgaaaggcccttgattccttcatggatgatcgctttcataaaaaaattccccccattcgagttggttgtgttaaattatggacatgaatgaaggtaaatgtaaaatgatttgcccggggccgcttagaggccttctgttttataaaggattgcaatgaggcggaaattccattagtgtaatacagaagcaagctagcaagtgaaggagatggaacatgagttttcacgatcaaaatattttacctgcggtacgcaatatgaagcagttcgatacattcctggacagccctttttcatacggggtgctgcttgacatccatcttggacagctgggaggcgtgatcagcgcggcaagatcccatgggaaaaaaatgtttgttcacgtcgatctgatccaaggaattaagcatgatgaatacggtgcggaattcatttgccaggaaatgaaaccggcgggcattctttctacgagatcaagcgttatcgccaaagcaaagcagaagaaagtgtatgcgatccagcgcatgtttttaatagacacaagcgccatgaagaagagcattgaattggtgaaaaagcacagacccgactatatagaagtgcttcccggagtagtgccggaattgatcagggaagtcaaagaaataaccggcattccgatctttgcgggcgggtttatccgtaccgaaaaagacgtcgagcaggcgcttgcagcaggggcgtccgcagtcaccacctcagacactgatttatggaaaaaatactggaactaaaaatttaaaatgtgaaaaattattgacaacgctttcactatacgatacgatcttactaagttaatacattgtgacggagacccggagaccacagcagttctttactcagtatgatgtaaagaaagtttgctgtgtttttttatggtcttttagacacagtggagaaggtgaacttatggcgttcatctattagaataatacttcataatagattttaggagggatagccttgacagcattttggggggaagttatcggaacgatgctgctcatcgtctttggagctggagtttgtgcaggagttaatttgaaaaaatcgctgtcccatcaatccggatggattgtgatcgtcttcggctgggggcttggcgtggccatggcggtatatgccgtcggcggcatcagcggagcgcatttaaatccggccgttacattggggctggcatttgtcggagattttccttgggaagaagtgccttcatatattttgggacagatgatcggcgcatttttaggagcggtgctcgtttttcttcactacttgccgcactggaaagaaaccgaggatcaaggcgcgaagcttggagtattttcgacaggtccggcgattccaaatacatttgcaaacctgttcagtgaaacattggggacttttattctcgttctcggacttttaacgatcggtgcaaacaagtttactgacggactgaatcctcttgttgtcggatttctgatcgtggcgatcggtatctcgctcggcggaacaacaggctatgcgattaaccctgcccgcgatctggggccgagaattgcccattttgtccttccgattgcaggcaaagggagttcaaactggaagtacgcgtggatccctgttttaggaccggcgcttggcggttcatttgcaggcgttttttacaacgccgtattcaaagggcatatcacaaacacattttggattgtaagcgttatactagttgtgatattgttaggtttctatattcatatgaaaaaacaagcagttgatcaatcggtcaacatttaaaaaaaacgcaatcttaacagacatataagggggagtttcaaaatggaaaagtacattttgtctcttgatcaaggcaccacaagcacaagggcgattgttttcaacaaagcaggcgaaatcgtccatattgcgcaaaaggaattccggcaatattttccaaaccctggctgggttgaacacaatgcaaacgaaatctggggctctgttctgtcggtgatcgcttcagcgctttcagaatcggggatcgaagccggacaaattgccggaatcgggatcacaaaccagcgggaaacgaccgtggtttgggataaacataccggcaaaccggtctacaacgcgattgtgtggcagtcccgccaatcggctgagatatgccaggaattaaaagagaaaggctatgaagagacgatcagagaaaaaacagggcttttaatcgatccttatttttcaggcacgaaagtgaaatggatcctggatcatgtggaaggggcaagggagaaagccgaaaacggcgaccttctcttcggtacgatcgattcttggctgatctggaaaatgtccggcggaaaagcgcatgtgacagattattcaaacgcctcaagaacattgatgttcaacatctatgacctaaaatgggatgatgaacttctcgatattctcggcgtgccgaaatcgatgcttccggaagtcaagccttcatcgcatgtatacgctgaaacggtcgattatcatttcttcggcaaaaacattccgattgcaggtgcagccggcgaccagcaggcagcattgttcgggcaggcttgctttgaagaaggaatggttaagaacacgtatggaacaggctgctttatgctgatgaacaccggcgagaaagcgattaaatcagagcacggcctgctgacgacaatcgcttggggcatcgacggaaaggtggaatatgcgctggaaggcagcgtcttcgtcgcgggttccgctattcaatggctgcgtgatgggctgagaatgtttaaagacgccaaagaaagtgaaaaatacgctgtaagagcagaatctgccgatggtgtttatgtggtccctgcatttgtaggtttaggcacgccttattgggacagcgatgtccgcggcgctgtattcggactgacccggggtacgacgaaagagcattttatcagagcaacgcttgaagcgcttgcctatcaaacgaaagacgtgctggacgcaatgaaggaagactccgggatcccggttaaaacgctgagagtcgacggcggagctgtcaaaaacaacttcctgatggattttcagggcgacattttagatgtccctgtagaacgtcctgaaatcaatgaaacaacagcgcttggttcagcctatttagcgggccttgctgtcggcttctggagcgatcgttccgagatcaaagaccagtggcagcttgacaaacgttttgaaccgaaaatggaagaaaaagagcgtgagagcctgtacaacgggtggaagaaagctgtaaatgcagctagggcttttaaataagctgcatgtatgttacaatctaattaagttaatagaaacggttggagaagaggagagaccgcagacaccaaagcagtatcagcgctttggatgtttgtggtctctttttctattttttaccgtgacaacaagggaggacatgaaacatggaatcattattttcaagccgtaaacgggacgacattttacagaatatgacaaagcagaagtatgacgtgtttattatcggcggaggtattactggggcagggacggcattggatgccgcatcgcgcggaatgaaaacggcgctttgcgaaatgcaggactttgcagccggaacgtcaagccgttccacgaaacttgtacacggcgggcttcgctatttaaagcaatttgaagtgaaaatggtagccgaggtcggcaaagagcgggcgatcgtctatgaaaacgggccgcacgttacaacgcccgaatggatgctgcttccgatgcataagggagggactttcggcaaattcagcacttcaatcggactgagggtgtacgactttttggcaggcgtcaaaaaagctgagcggaggagcatgctgactgccgaagaaacgcttcaaaaagagccgctcgtgaaaaagaacggcctgaagggcggcggctattatgtcgaataccggacggatgatgccagattgacgatcgaagtcatgaaagaagccgttaaattcggagccgaggccgtcaattatgcaaaagtaagcgattttatatatgaaaacggcaaggtcaccggcgtggtcattgaagacgtcttcacgaaaaaaacgtaccgcgtctacgcgaaaaaaattgtcaatgccgcggggccgtgggtcgaccgtctgcgggaaaaagaccattcaaaagaaggcaaacaccttcagcatacaaaaggcgtgcatcttgtttttgatcaatcggtctttcctttaaaacaagccgtttattttgatacgcctgacggccgcatggtgttcgccattccgagagacggaaaggcatatgtcggcacaacagacaccgtctacaacgagaatttggaacaccctcgaatgacgacagcagacagggattatgtcatcaatgcaatcaactatatgttccctgaacttggaatcaaagccgaagatgtcgaatcaagctgggctggcctcagaccgctgattcatgaagaaggaaaagacccgtccgagatttcccgaaaagatgagatctggacttctgaatccggactgatcacgatcgccggcggaaagctgacaggctacagaaaaatggctgagcatatcgtcgatcttgtcagagaccgattaaaagaagagggcgacagagacttcgggccttgcagaacaaaaacgatgccgatttcaggcggccatatcggcggctccaaaaatctggaggcttttattcaagcgaaagcagccgaagggattgaggccggactgtccgaagagacggccaaacaaatcgccgcacgatacggttcgaacgcagaccgcctgtttgatcgtattccatcgctgaaagatgaagcagcaaaacgccgcatccctgtccatgtactagcagaaatggattacgggatcgaggaagaaatggcagccgtcccggcagacttcttcgtccgcagaaccggtgcgctgttctttgacatcaattgggtccgcacttacaaagagagccttacggactacatgagcgagaagctgaactgggatggcgaaacgaaggcccggcatgtcaaggcattggaaggactactacacgatgctgttgtcccgctggaaagcaaatgatttattaggtcaaataaccttggtgaattttcgttaataatcaatcgaatggcccggcgtgaggctgtcttgaacaggcagcctcatttttttcatttggcatgctaaatttggacaaagcggcggtttgtcgatatgataaaagaaaagctgcaattacttagctagaacattggaggtaatcatgagctggagaacgagctatgaacgctggagaaacaaagaaaacttagattccgaattaaaagcgcttcttttggaagcggaaggaaatgaaaaagaactagaggattgcttttataaaaaacttgagtttggtacagccggtatgcgcggtgagatcggaccgggcccgaaccgcatgaacgtttatacggttcgcaaagcatcggcgggccttgccgcatacataggagcgaacggcggcgaagcaaaaaagcgcggcgttgtgatcgcgtacgattcccgccacaaatcgcctgaatttgcaatggaagctgctaagacgctcgcagaaaacggcgttcaaacgtacgtgtttgacgaactgcgcccgacacctgaactttcctttgcggtaagagaactgaatgcgtttgcaggtattgtcatcacggcgagccataacccgcctgaatacaacggctataaagtgtacggagaggacggcgcgcagcttccgcctgctgatgccgacaaactcaccggctatgtcaatgcgatagaaaacgaactggaaatcgaagccggagatgaagctgctttaaccgaaaaagggctgattaaaataatcggcgaggaaatcgatcaagcgtatctcgataaactgacatcgatttctgtcaaccctgatctggcaaaggagaccgaagtcaaagtcatcttcaccccgcttcacggcacggcaaacaagtctgtcagacggggcctgaaagctctcgggtatgaacatgtcacagtcgtccccgaacaggagctccctgaccctgacttttcgaccgtatcttctccgaatccggaagagcacgccgcttttgaatatgcgatcagactaggagaagaaaatggagccgacattctgatcggaaccgatccagacgcagaccggctcggcgtcgctgtaaaggatcaagaaggccgctacgtagtgctgacaggaaatcaaaccggcgcgctgctcctgcattatctgctgtcgcaaaaacagcagaaaggcatgctgcctgataacggcgtcgttctgaaaacgattgtgacgagcgaaatggggcgcgacatcgccgcttctttcggactggacacgatcgacacgctgaccggctttaaattcatcggagaaaaaatcaaacaatttgaagcatcgggcgaatatgctttccaattcggttatgaggaaagctacggctacttgatcggcgacttcgcaagggacaaggatgccgtccaggccgcactgcttgccgttgaagtatgcgccttctataaaaagcagggaaaatcgctttatgacgggctcctcgaattgtataaatcgttcggcttctatagagaaggcttgaagtccctgaccttaaaaggaaaagagggagcggagcaaatcgcagccatcctcagcacattcagagaacagccgcctctttccatcgccggaaaagatgtcgtatccgccgaagactatttgacagggaagcggacgctgctaaaggaaaacaaaagggaaacgatcgaccttccgaaatccaatgttttgaaatatttccttgaagacggctcatggttctgcctccgtccatcaggaacagagcctaaagtgaaattttatttcgcggtcaaaggccgaaccaatgaagaaagcgaagcgcttctcaatcaattgacagacgaagtgatgaaaaaaatcgacgatattgtaaaagcgacctcaaattcgtaatcgctgaaaaccctcctttaaatggcgggtttttttattgtgaagagacgatgaatgatgtaatatatatttaacattaggtcatatataaattgcatattgaaaggagagaatgactgatatgaaatggatcaaaatcggggatgaatacatagaaaagaaaatgacgcaatttttcagcgaagccggtacgattgtcgctgccattttatgtttggatatgatcatccgcggctttattttaggaaaacctgcatccgaatacatcatcagtgccatcggttttgcggtctatgcaggctggattttgctccgctatcttttgtcgggatttgaatatccggagatcgcaggccaatcggcgtatcggaaaaaaagaaaagaaatcgcagccctcagcctcgcttccggcctcatatttgctattttaacgcttctctttaccggcataccagagcatcccggcagttgggttgactttattggtatggtgatgttgtttgcattccttcattttctgatcaactttatctcgttgcgcaattcctttcggaaaaatcaagatctattagatgattaaatcaaaacggcaggtgagcatatggttaaccgggtcaaactcgcccggatcgaaaagtctttgacacaagcccagctcgccgagcgggtcaatgtgacaaggcagacgatcgggctgatcgaaaaaaataaatacaatccgacattgcagctctgcatcgcgatcgcaaaggcattagacaaaacgcttgacgatttgttttgggaagaaaaagcctaaggatgagctttgccctttctcggtcaaaagtcttagaaaagatcatctcatgagggcgggcttttttttatcaactatcggtataatgaaagaaactccggtttaaggggatgaaacttttgcgggaagacacacagtttgaaaaactgaaaacgctcaaagaaatagcggaaactttaaacgaagggaacgatctaaaggaaacgctccatgccgttttaaagaagctgctccgcctaacgggactcaaaacggcatggctttttctgatcgatgaaaaggggagctttgaactggctgcttcggcccgcctgcctcaagccctttcttaccggcaaaaccgtttactatgcgaaggaagctgctactgtcttgaacaatacagggacgaaaagctggacagggcgaaaaatatcatccactgccggcggattacgacggccatgaaacagaagacaggagatccggaaggcatcacccatcatgcaaccgtcccgctcagtgaccaaaagaagcggttcggtttgttgaacgttgcggcaccgggcaaaattcatttcagccgcggggaactggcgctcctcgaagctgttgctctgcaaatcgggatggcgatcaaacggatgaggcttgctgaacaacagcaaaaacacctgctgctgaccgaaagaaacagattggctcaggacttgcatgattccgttaatcaaatgcttttttcgctcagcttgaccgctaaagcggcgggggaaatgacagaccagccggaaatcagggaaatgctcgagtttatgcaaaatctttctcatgaagcgcttcttgagatgcgggcgttaatttggcagctcaggccccaggggctggaagaagggttagcggcggctcttgaaaaatatgcggaagtgctcggccttcaagtaatcttcaagctcagcgatgtgctccgtctgcccccttctgttgaggaattgatgtggcggctgagccaggaagccctcaacaattgcaaaaagcatgccggtgcaagccgcatacaagtgaaaatcaatgtattccagtcgtctgccgtcttggaaatcgaagatgacggcaaagggtttcagtacgatcctaatgtggacattccgacgcttgggctgaaaggaatgaaggagcggacggaaaaagcgggcggcacgcttttgatcacctccgcaatcggtaaggggacaaaaatccgggcggttttgcctatgaaggagaagggggaggcaggatggagaaggtgaaaatcatcattgccgatgatcatcatattgtcagaaaagggctcttgtttttcttcaaaacaaaaagcgattttgatgttatcggagaggcttcgacaggtatcgaggcgctcgatgtcttgcgaaaacgtgaggcagacatcgtattaatggatttatcaatgcctgatatggacggcattgaggcgacaaagcgaataaaaaaggaatatccgtctgtcaaagtcatagcgctgacaagctatgcggacgagagctatgtgattcccgccatccaggcgggagcctgtgcctatcagctgaaagacgccgagcctgatgaacttgtcgagacgatccgcgcagtttatggcgggagatactcattggatccgaacatcatgtcccacgtctttcaccatgtgtcacaggcggatgagaaagaaaaaatacatcaattgacaaatagagaaaaagatgttttattggaaattacgaaagggaaaagcaataaagaaattgcagcatctttatttatcagcgaaaaaacggtaaaaacccatgtatccaatctgctttcaaagcttggcttatccgatcgcacgcaagccgcgctttttgcagtaaaacacggactacaacaaaatgacgggagaggatgaccaaatgaaaataaccgtaattagcggaactgcgagaaaacagggcagaacgcggatcgccgcttcctatatcgcccgcgcttatcaggctgagcttatcgatctaagcgagttcatccttccgattttcaacggagacgaagagcaaagctcgctggagaatgttcaaaaattgaaagcttcggtcaaagaagcagacgctgtcgttttattatctcccgaataccacagcggtatgagcggcgctttgaaaaatgcactcgattttttaagcaatgagcagttctcgggcaaaccggtggcgctttttgcttgtgcagggggcggcaaaggcgggatgaacgcgctcgccaatatgcgcattgtcgcacgcggagtttatgcgaacgtcatcacaaagcagcttgtgctcgatccgattcatattgatgaggagcaccaaacggttactgaagcagccaaagccaatattaaaaatgtaatggaagagcttctgctctttgccgaatttcaaaaagcctgacgccgacagagcgccaggcttattttattttacgtaaagacaagcacgccgttttcgtgttcatgtccggaaaatgaggcgtgatcaatatactgcagcagatcataaagccttttttcgacaatggcgtcatctctttcaaaattgtaggcgtgcaaaaaatgttcgatccgctttgataataaatcgtcttctgtccgcaccatcaggatcagcaggttgtcccactgcgaccggtgcgtatagtacaaagctttgtcataatcagcgtaattcaatttcgccactctcccttctttctgaggagtcatgcttattttatgtggcggggtgtttttttctccgggcaaaacttggtctcccttgtttggcggcctagaaatatgaggatggtatatgcagaccgcgaaaaatgtctgcatgacattcgccgtttacggtcaagctaacgtatgtacaatacatgcggagcgaatagaaatgaaaaaacgatattgcacgtactttttttgcatattaacacttttatcattcccggcgaaaggccactttcaaacagatgttttcgatgcacctgaacggtgggaaagaatcgcctggagcgcgcttgaagaaaaatacaaaggcgcaaagctcgaggattatgaatatttagggcgcacacaagtaaatgatgaagagacaaaggatgtcttcagggtaaccgtcaatcaagaaggcaaatcattttcggcgcacgccgaggtgtattttcatccggtgaccaatgcgatcatcaatgtcaatatttttcccttatagcaaaaaaaacgaaggaaaccgtttccttcgtcaactcaataatttacgtatatggtcctgattcatgataatatcttgcagagtgtattggtccaatacgtccaaataggcggaaagggctttgtttaaaacatgctttaatccgcagatcggagaaagtatacaatggtttttttctccgttaaaacactcgacaaggttaaaatcatcttctgtatgtcttatgacttcaccgatattaatcagttcaggcgcttttccgagacgaatcccgccgttgcggccgcggatcgtttcaacgtagccaagcttgccaagctcgtaaatcaccttcataaggtggttttttgaaatggaataagaatcggcgatgtctttaatattgacaagctcgtttgagtttttggttgctagaaaaatcagtaccctcaatgagtaatccgtataatttgttaatttcatcgcatgacctcaatcaaacaagtttccattatcttatcacatttgccttcgattatgagggtcgagcggaaattgttacaaaaatataaaacattcattgataatattgctttaattccattaaaagtctagtataaagatgtatctaaaatacatctttaatcaaaagtaacagtcctatttaaaaaagatcttattgcacctttaaagatgtatttcaaatacatttttaaagtgactggagaggagcaggcgttatgctatctgaaaaaaccatgcaaattgtcaaatcgaccgcccctgttttaaaagaaaagggaacagagatcaccacttgtttttacaagcggatgtttgatgcccaccctgaattgaaaaacattttcaacatgtcccgacagcaaaccggcggacagccgaaagctttggcttttactgtgctgcaggcggctgaaaacatcgaccggctcgaagacctgctgccggttgtcaagcagatcggacataaacacaaaagtttgcatgtgaaaccagagcactatcctattgtcggtcagcaccttttggaagcaattgaaatcgtgctcggcgaagctgcgacagaggacattctccaggcatgggcagaagcctatgaagagatcgcccgtgtatttattgaagtcgaaaaacaaatgtatgaggaagacaaaaagcaggatggaaattgggaagggtttaaaccgtttgtcatcatggataaacgagtcgaatccgatacgataacctccttttatttgaagcccgccgatggaacggctttgcccgctttcagccccggacagtacgtatctgtctgcattaaaattccgggcgaaccatatttcttaacaaggcagtacagcttgtcagatgcttggaataaagactactaccgcatttcagtcaaattggaagcggaggaaggccaaccggtgggaaaggtatcaagctatctgcatgagaacatggaaatcggcggcagcttggaagtgagcgctcccgccggagatttcacactttccgaaggaacggatcgtccggtttatttcattagcgccggatcaggcatcacgcctgtcatgagcatggtgcaaacgttggctcaaaaagaaagccgccgcgagatcacattcgtgcatgccgcgaaaactgaacggcatcacgctttcaaggaagaaacggagaagctgctcggcgccaatccggcgaaccgtctcctgttcgtctacagcagaggtgctgaagcgacggaagagcatactgtaaaaggccgggtgaatgaagagcttttgaaatcggtcgtgatagatccaaatggcgaattttatgtatgcggtccgctttcatttatgaaaagcgtgattgaaggattgcaaaaccttggcgtttcgatggaaaacatccgctatgagagctttgcttcatctcttgatatgcaaatagcgaactaacctcaagaaggcagctgtcaaaccgacagctgcctcagcgtgtcgacaaaccctcgcatacgttgtcagtcctgcgcgtcggtgctcacgaattccaacattcgctccgctccgatgctcggccttcctagactgcaagggttttcaatcacgctgaaagaaggatgacaaaatcccaaaactaagagctgttttgggattttgtcagcaatctaaggcagctgtcaatccgacagctgcctttcatcttttcaaaacccggctcatacaataaagagaagtccaaccgggggggatttgagtattgagcatacgggagcaaaaagagctgcagcgggcgattgaagaaattacggaaatcgcggaaggattcggccttgatttttacccgatgagatatgagatttgtcctgctgaaattatttatacattcggtgcatacgggatgccgacaagatacagccattggagtttcggaaagcaatttcacaaaatgaagcttcactatgactttggcttgagcaaaatatatgagcttgtcattaattcagatccgtgttatgcgtttttgctggacagcaattcattgattcaaaataagctgattgtcgcacacgtccttgctcattgtgatttctttaaaaataactgccgttttcaaaatacgaagcgcgatatggttgaaagcatgtcggcgacagcagagcggattaaacattatgaaacggtacacggttcaaaagaagtcgaagcatttctcgatgcggtgctggcgattgaagaacacattgacccttcgctcgtgaggccgaagctgtcgtggagcgtagatgatgaagaggaagaagaaaccggcgcgccggccactccttatgacgacctctgggaactggatcataaaggatcgaaagagaagaagaaaaggacgaaaaaaaagtttccgccgaaaccggaaaaagacattctgctgttcatagaagagcattcgcgggagctggagccttggcagcgcgatattttaacgatgatgagagaggaaatgctgtatttctggccgcagcttgaaacgaaaatcatgaatgaaggctgggcgtcctattggcatcagcgaatcatccgtgagcttgatctgacatcaagtgaagcgatcgaattcgccaagctgaacgcgggagtggttcagccgtccaaaacgggaatcaatccttattatctcggattgaaaatatttgaggacatagaggagcgctacaacaacccgacagaagacatgaaaaagatgggggtagagccgaactctgggagagaaaaaatatttgaagtcagggagatcgaatcagacatttcatttatcaggaactatttaacgaaggatcttgtgatgcgggaagacctctacttgtttcaaaaacagggaagggattataaaatcgtcgacaaggattgggaggctgtgcgcgatcagcttgtcagcatgagagtcaacggaggatttccttatttgacagttgaggacggagattacttaaagaacaatgaattatacatcaagcattggtatgaagggatcgaactcgatttgaagtatcttgaaaaagttctgccttacctccaccagctatggggaagaagcgtgcatgtcgagaccgtgctcgaagataaacccgtcatgttttcctatgatggaaaggctgtccaccgcagatatttataaaggctgcattttggcagccttttttcttttaaagcgcaacgatttcaactcgtccgtcctttcaaaagaaatgccaaattaatgcacgtttgcccagttttacgacttcattataaaaatgtaaaataaagtatttaatgatatttctaaaattgtaattttagctgccggaaagcgtaaaaatgtagtatttaagttacctttgaaatgtaaatgaaatattatctacccttaaaaactttttttgaaaacgaataattaaggaatttgacatagtaagtcaagactatacctgatggaattccctccttataatagaagcagaggaagggctgaagcagccgttctcaaaaaaatgaaactgctaattttcgcctttgaaaatataaaatattctgctattgggaggacaacatgaaaaaacaagtaataacagcagcatcagcggttgttttaggatcgactttgtttgcgggagccgcttccgcgcaaaccataacggtgaaaaaaggagacacgttatggggtttttcgaagaagtatggcacaactgtcagcaagattaaacaggaaaacaagctgaaatccgatatcatttacataggacagaggctgtcgatcaatggaagcagttcttcgtctgcaaaagcgtcgaaagtttcatcagctacgcataaagtggtcaaaggagacagcctttggaaaatttcgcggacatacggcatgactgttaacgaactgaaaactctgaacggtttaaaaacagatttaatccggattggacaagtattaaaagtcaaagggacgaaaagcgtaaaagcagcatcaacaaccaagccttccgcatcaagcgggacaagcaaaacaagcgcacctgcgcagaaatcttcaacgctgaatacgtcaaaacttgtttctgatgcaaaagcccttatcggaacgccttataaatggggcggaacatctacatcaggatttgactgcagcgggtttgtctggtacatcctcaacaaacagacaaatgtagcgagaacgaatacagtcggatactggaattcaatgaagagcgtatcaagcccggcagtaggcgatttcgtattcttcacgacatatcagccgggaccttcgcatatgggggtttacatcggaaacaatcaattcgttcatgccggttctgacggcgtaacgatcagcgatatgacaaacagctattggaagccccgctatcttggagcaaaacgcttctaatgttgcagggacaagcccgttcatcatgatgaacgggttttttccgtttagaaacggaactcggctaaaaacgccaaaaagtgctcgaccttctcattatctttcagactaatcgcatatccccctgcaacgggaagcttcatgaaatcgcacggcacctctattaatcttccttccatcagctcgcggcgcacagtcgacagcggcaaaaatgatataccgagtccttctgaaataaatcgtttcgtaatatgcgtctggcttacgagcatcgttctgacaaacggaaacttgatcctcagctgcctgacgaggtcgtcccagtattcagggtgattgtgggtcaacagcaaatattcttcaagcaaatcctcgacatcgagcggcggcgcttgttctgcagcgcggccgtcatgaggggcaaccaaaatcacgggatcgctgtacatggaatagcagttcaggtttgacgattgcacgtttaagcagcttagtccgatatctgcatggccagctgaaatcaggggagcgatttcagctgattcggcgatctttactttgatctccgaattcggatgcagcgctgtgtatttttttaatacaaatgggagaatcgtatcggcgataagcggcgaaaccgctaagttcaatgtctgtgagtagccttgtctgattctgtgaagctctgccatgctcgattcatagtcttccaacaggcgaagggcaaaaggaaggtaagcccgtccttctttcgttaaatgaatgcttcttcctttgcgggtgaacagctggcacccgagttcttcttcaagcagtttaatttggacggtgacggtcggctgagaaataaataaggtttccgccgtctttctgaaattttcgtattttgcggcagtgacaaaggtatgaagccatttaaaatccattgcagtcctcctgattaattttattaatcaaagacatcaatataattcaatattttttaaatattatatcaactataataatatttacaaaggaaaaaggaggaattgatatggtttatcatgggttaaaagggattacttgtgttgaaacagccatcagccgcattgacggtgaaaaaggaaagctgatctacagagggtacaatgctgatgaactggcgctttcgtccacatttgaagaagtcgcttacctgattctcaacggggcatttccgacggaagctgaactcagcagattcaatgagctgctcgcttcatttcgtgtgcttccagaagcatgcgagcgattgatccgcagtcttccggccgaattagacgatatggcggttctgcgcacggccgtctcttcattcggggacatatcgtttgcgttcaagccgacaatggagcaggccctcaggctgattgcggccgtcccgtcaattatcgcgttcagaaagaggctggctgatggagaagagcctgttcagccgctggatgagctaggttttgtggaaaattatttttacatgctgaaaggaaagcgtccgacagaagctcagaaaaaagcgcttgaaacgtacatgattcttgcgatggaacatggcatgaacgcttcaaccttttcggcaagggttacggtgtctacggaatccgatcttgtttctgccgtcacatctgcacttggcacgatgaaaggacctttgcacggcggagcgccgtctgcggtgacggatatgctggaaggcatcggggaaaaacagcacgctgaaagctatataagagaaaagcttgaaaaaggcgagagactgatgggatttggacaccgcgtctataaaacgcatgatccgagagcgaaggctttaagggtgaaagccgaggaaattgccgggggcgacagggatatcgaccttgctcttcatgttgaaaatacggcgatccgccttttggaagaatacaagccgggccgcaagctttatacgaatgtcgaattttacgcagccgctgtgatgaaggcgatcgattttgatgccgcattgttcacccctactttttcggcagcgagaatggtcggctggtgcgcccatgtgcttgagcaggctgacaacaacatgattttcaggccatcggctaaatatgtcggagaattggtctcacagtaatgcggacacacgccttctcatcgaagcgcgtgttttttaataggattttttgaatgtttagtagggaatcatgccggtgctcttgaatgtattcatcaagaaagtcctttaagggggagacgatgaaaaaaggattcctgatgttgatcatgctgttttttctaggtgcatgcacggaaggccgggattttgatgctgaatatgaagcgacaagcgcgaaagaaggcggaagcggcgccgaagtcatcgcagatcgcctggatgtgccttggacgatcgctcatactggcgagaccttttacattacggaaagaaacgggggaattgtgtccattgctgacggcaaaaaggagcgcatgcagcttcagctgaaaaagcccgttcatcaagaaggggagggcgggctgctcggatttgtactccatccggattttagaaacagtcaggaggcgtacgtttatcatacatacaaagacgggagccatctgaaaaaccggatcgtaaaattgacgcttgaccgcctcacttggacagaaacggatgaactgcttgccgatttgcctggaggcgcgattcataacggcggccggatggcgatcgggcccgatcaaaagctgtacatcacgacaggcgatgcaggggaaagggaatgggcccagcagcctgaaaagatggcgggtgtgattctaaggatggagcttgatggtacgataccggctgatcagccctttagctcgtcttatgtatacagtttcgggcaccggaatccgcaaggcctcgcatggatcggccgacagctttacagctccgaacacgggcagtctggacatgatgaagtaaataaaatagaacccggagccaattatggctggccggtgattgaagaaagcgatgagaagcagggaatgaaggcgccgctcatacattcgggagaaaaaacgcgggcgccatccggtttagcacagaaaggggacgtcctctatatggccgggctgcggggagagggtgttttccaggtcgatccggcggaagccaaagtagtcaagtggcttggcggatacggcagaatcagagatgtgaaagtgatcggcgatgatctgtatttcattacgaacaatggcgacggaagaggcgaaaaaaaacagacagacgatcggctcatccgcgtacctctgcctgacaagtaacctgtctcgcccgtttgcgtttaaggatgccggaatcgtggtaactgagcactaaacaatggtgaagaggtgagacaaatgaatccggcaaacagacagacagatggacagaaagcgcaaaaacaagaaaaacaacccggtgctgagcacaagatggtgccccttccgctctcggaagaccgcgactacaaaggaagcggcaaattaaaaggaaaaacagcgattattaccggaggagacagcggaatcggcagagcggccgccattgcatacgccaaagaaggtgccgacattgccgtcatgtacttggatgaacacaaggatgccgaggaaacgaaagagcgaatcgaacaggaaggagcagaatgcctcttgattcccggagatgtcggtgatgaggcgcattgcaaatcatctgtcgaaaaaacggtgaatcactttggcgggcttgacattctcgtgaacaatgctgcagaacagcatccgcaaaaagggatagaagatatttcgaccgaacagcttgaaagaacgtttagaacgaatattttctccatgttccatatgacaaaagccgcgctcccgcatttaggggaaggcagcgcgatcatcaataccgcatcgatcacggcgtatgaaggcagtccggcgctgattgactattcgagcacaaagggcgcgattgtcgcgtttacccgttcgatggctgcatcccttgtcaaaaaaggaatacgcgtcaacgctgtagcgccgggtcccatttggacgccgcttattccggctacttttccgccggaaaaaacggaaaaacacggcacagatacgccgatgggaaggcccggacagccttctgaacacgctgcagtgtatgttctgctcgcttcagacgactcctcttatatgacaggacagacgatccacatcaacggcggaagatatgtgacgacataatcccaaccggctgcttattgtaaggcagccggtttttttctgtttgttttttcggaaaaataagaatttgaaagaccactttcaaaaaagctgccccgtaagagataatagaaacagaaagagaaaggatgtgtatgaatgagcgaccgcagaatgacagcaaagtgggcatccaaacttggatttgttctcgccgccgcggggtccgccatcggtctgggagcgatttggaagtttccctatgtggcgggaacgagcgggggaggcgcatttttccttgtgtttgtcctatttacgatactgctgggataccccctgcttttgggggaatttgtattaggccgaaaaagccaatcggacgctatcggcacctatcaaaaaatagcgccagggacgccttgggtgatcacaggctggatcggaatcgccgcctgcttccttgtcctgtcgttttacagcgtgatcggcggctggattttgctttatatcattaaagcagtaaccggttcattgtcgggtctcacgcaggccggatacggggagctattcggttcgatcatccaagatccgctgcagacactggcagcgcagcttgcgtttatcatcatgacgatcctcgtcgtggcgaaaggtgtgcaaaaaggaatcgagcgcgtcagttcgattatgatgccgctattatttattttatttattgcgctcgttttaagggctctgacgcttgagaatgcgatcgacggcgtgcgttttctgcttgtgcccgattttggcagcctgacgccgcaggcgattctttttgcgctcggacaagctttctttacactgacgcttggcgtatctgtgatggtgacgtacagctcctatttgtcaaagtcacaaaaccttccgaagtcggcgctgtcgatcgtgatcatgaaccttgccgtcacgctgcttgccggcttggcgatttttccggccgtcttttcattcggccttcagccggatcaggggccgactttattatttgcggttctgccggcagtttttgaccggcttccattcgggatgctgttttttatcggatttttgacggcctttttattcgccgccttgacttcggctttttcgatgatcgagatcattgttgcggccattacaaaaggcgaccaaacgaaaaggggaaaatggacgtggacgatcggccttttgatttttgccgtcggcattccttcctgcttgtcttacgggatgcttgatgagccgttcatttttaagaagacgttttttgatgcggcggattatgtcgtcagcaatattttgatgccgcttggcgcgctctttatctccatttttattccgctgaaattgtccaaacacgatctatatgaagagatgaaaagcggatcaaaagcggggaaaggcttttttatcgtgtggttttatcttcttcgtttccttgttccgcttgcgattgtacttgtttttttaaatttaatcggagtgttttcattttaaaagatcaggagatgggtgaatatggtgttagactttcaacagatgtttccgagcgaggatggcaatcacgaggcgcggtatcagctgctggcattgcttgaagcggtattggccggaatggacaggctgaaggattccggccggctgacgcttggccgcgagtctgaagtttcatctgactactatcaaagcgtcattgaagaggccgtcttgccggaaaaaggcttcggggcggaaaaaagcgttgaagagctattgaaattgcttgacggccaccgctttttaaacaggcattatgtggccaacgcgacgcctctgccgaacaacgccagcatcgccgggaatcttttaatggttcttttaaacggaaacaatttatgggatgtcgacggcacggctgcagccaggacggaagtgcagatcacggcgatgctttctgatattgtcggctatgacaggcacaagagcggcggttttacaacctggggcgggcagggagccgtttttcagtcgctcaggctggcgatcgcaaacgcgtaccctgaagcgaatcagcaaggaacgccgcatcatctgtacgcgttctgttcagagctttcgcatttcagcctttataagtcgatggaagcttccggaatcgggacggaccatttgatcaaggtcaagacgaatcacgatcattcgatggatctggccgatttgcgggaaaaaatgcaagccgtgattgaaaaaggcggacatccgatttatgtattggcaacgcttggcacaaccgacgcatttggcatcgatgatttggccggaatcaagaacgtgactgaagaaatagaggccgcatacggtttgccgcctgtttatattcatgccgatacggcgatgggcgggatgtacagcttttttaacggatacgatttctccggcaatccgctgcatattgaagatgaggtgcttgagacgcttgcccgctacaaacaacattttcagcatttgcacctggcggacagcttggtctttgattttcataaactcggacaaacgccgtatatcacaagccttttcttggtgaaaaaccgcaaggcattgcaggctgttgatttggatccggatgagacgccttatgtcggcaacagagggtttggcagctatcatacgagctatacgctagagtgttcgcgaatgggaagcagcataccgatttatgcttctctgctcgcatttggaatcgaaggctaccaggagatcttggccaattacatcagggttaacctggcgtttcgaaaaaaactgctgcaggcttttccgaatgcagccgtcaccaatgatgtatcacctgtgacgacattccgcttctatccgggaaatgtccgctatcacgaagaaatcagcggcgccatcacggaggaagaagtgcggaatattaacaaatacaatgagaaaatcgccgaaacattgggaaggtaccgcagtcacacctatttcggcagcacgaaaaagcaaacatacgtttatcctgctgacagccgtttgccagtgccgctttatgtccagaaattctacagtgtctcgccttacacgacggttgatacaactgatcaatatatcgcctttttaaaagcgcatgttgaaacgtcggatgtagcggctggataaaataaagaacaggaggtttgaacctcccgttctttatttagttcttacatgccgttcttttttgaaccggtatccatatttcgcttttaaacgttggggagctgatatcttgatcctgattccagaggatttccggccctttcgtttgctcataatgtgaagacgggaaccattcagcataaatgcgcccccagacattttgaagggtgtccggaaacgggccggccgcttcaaagacagcccatgtcgaggccggaacttcaagctgttcatattggtccggacattctttcgttgtcgctgtaccgatataatggtcaagttctccctgctcttccatcctgccttcggagaagttcgctgatgcttgaatcagtccaagcggttccacatttgaaagctcctttaattcatcgatgttttcactgcttaaagttttccacatcgaggcgatatccggattgattccgtgaaagacgacagggactctttttttgattccgacgatccggaatgccttcttttctacaatacggtagttcatttcgtttcctcctctaattgttaactggaaggtcatcggaggatatgctttcagtgtgctgatatcgtgtctggcctctgtcggcgtaatgccgtgcagcttttgaaatgcgcgcgtaaaagcatccggcgagtgatagccgtatttcaccgcaatatcaatcacttttctttttgtgttcttcagttcaaacgctgcaagggtaagccgcctgcggcggatgtattcggacagcgaaaccccggcaagaaaagaaaacatccttttaaaatgatattcagagcagtaagaaagcttcgcaaccgtttgaaagtcgatactgtccgtcaggtgttcttcgatatacgccatggcttgattcatgttcttcagcaaatccatttgatgacctcctctgtttacaaatatagcaggagcagaatccccatatccgactttccgtgcccgattgtgcagggtcaatcttgagactgtccgccgttaaaccatgcagtcttcagctttttgatgccgtctgcgatgcttttttcagaaagtccgccaaacccgaggaggaccgcgtgtgtatcaggggggggcatatacgagactgaggctggatatactttaacccctttttccagcgctttttgggtcagccactcttcactcggggcgcttttcacctcaaggatgatgtgaagaccggcgttctctcctctgactgcggcatgaccgccaaattcacgcttgatggcatcaaggagcgtttttcgcttttttcggtagagtgttctcattcgattcaagtgcctttgataatccccgtttttcataaaaagagcaatggcatgctgtacatggcgggaaaccgtttgtttaaataaggatgccatgttaagcccttctttgacgagcggaaaggggagaaccatatagctgatcctgagggagggaatcagcgattttgaaaaagtccctaaatagatgacccggtcgttccggtcaagcccttgcagggaaggaatcggctgtcccgcatagcggaattccccgtcataatcgtcttcaatgatataagctccggtcgctgctgcccagtcaagcaactgcagcctgcggccgaccggcatgatcattccgagcggaaactggtgggacggagtggtgtatgcgagctgcggctgatattgttcaagatcctgcacggaaatcccgctttcgtcaaccggtattggaaccacattgaagccgccggttttcaggactgtttttgagcgatgaaatccgggattttcaaatccgacggttgtgcctttaggaaacagatggcacagcaactgcagcaaaaccggtgtgccggctccgatgatgatttgctcgggggaacagaccacgccgcgcgattctctgaggtaaaccgcaatcattttccgcagcggaatgtctccggccggggggccgctttgaaaaaggtcgtaccctgattcaccaacggttttggcgagcgtttttttccattgggaaacaggaaatgacgcgaggtctacatggccgtggtgaaaatcgatcatgtccgccgccgtctcatgttcttccagttctttttcggcaggaggaggaggcgcagtctgtgcaaagtcaccttccgcttcagccgcaaaccagccctttctaggcttgctgagcaaatatccttctgcagccagctgttcataagcgtgttcaacagttgtcaggctgacatttaaatgtttggcaagcattcgtttggagggaagctttgttccaggctttatatgtcccgaatgaatgccgcgtttgaaaaaagtgtacagctgctgataaagcggctcgctgccgctgcggtttaaaaagggggttatatccattcgatcagccctttcaattcatctggtatgttttattttatcaaaactggccattttaaaaaggtcagtttccgggttaaagtagtttcataatcaacagaagggaatgacgatgttgcttgattgtagggaattgcattctgaaacagagcttaaggaagtctatccaattatgagacagctccgcccccatttggatgaaacgtcttttgtggagctcgtcaaagaagcgcgggaggctgaaagctacacgttatttgcgctgtacgacggggatattccggtggctttggccggctttttgccgagggtctctttgaaccaaggccgtcatgtttgggtagcggatctcgtgacgtgtgaaaagcatcgttcaaaaggctttggaaagaagcttttaggcgctgttgaagagtgggccaaacggaacggattggcttcaatcgctttatcatcaggggtgcagcgcgctgacgctcaccgtttttacgaagataaaatggagtataaaaaagcgagctatctatttcgcaaggcgctgaaatgaaaaaatccccggtataaccgggggtttattaaaagccgagctgcagattcgtatcgatggagacgatggtccatacgcaaacgagaatgaaaatgttcaggacgacaccgagaaatccgagaccggtccgtccttttttgataaagagctcgataattccgagcggaacggcggccattgcaaaaggaagcatcttatacgaatatgcgatcgtgtcgcttaaaatggccaagtttaagacgaacagggacagaatggccgtcccgacagacacccatccaaatacgttgtgctccttaaagattcttaccagttccataattccacctcacctactttagctgctttgacaggcccttttttgatcagccgttcaacctcttttgacggtccggtaatgactgctccatacacgttcacaccgttcttttccacataggcaagccgtttggaaagcttcaggtctttcctgcctgaaatggtttcagcccatttattgtgcttgatcatataggaaagcgccgctttaaactgttcctcgccgttttcggcagggtgctgaatttcaaaaatccggtttgaatcttttccaggaaaaccgatcggctctgcgtatggatgatcttttaaatcgccctctgtctcgatcgcattccacagaacgcgaatgtcatagccttttaattgatcatacagctcctttgtcggatatgctctttcaaaggaaagaaaagcttcagttacggtgccgtcaggaagctgttttaaaatcgactcggctttggacactgatttttctttgatgccgtcagggtagacgaaatgccgttcttcatttgacagctcctggttgtattgatgaatctgcggagacttcagctgatcgaagaacatttccacgttttcatttccaactacttttgtgacgtttccgatttgcttctttaacgggaattgtgtttggattccaaagagttttactttgttgacaagtgcttcggtatcgacctgaatattcggttttgtgacggcaactgtcattgaagcggtttgcaccagttcatttcctttgctttcatgcccgcccaagccgtagtatagatagctgccgagtgtgcaaagcggcagaataataagcgttgaaattacggcaagtgtggaaatccgcatatatgatttattttttccgtatcttaaaatcgctttttgcttttcagggctgattgccaaatcccagtcttcgtctttcatttcctgttccagcatgtcctggtattcctcaagctgttcaagctcttcttcgacccggagcatttccgattcggaaagttcgccgtttttatatttttcccaacgttttttaaaatcttcattcatcgttaacacctctgttgtaaagtgctttcagccgctgtctggcacgaaataaaacacttttaaaattagcctctgagatattcatcaagcttgacgcttccttgtagttcaattcttttaaatagtacagcgtaagcgcttcccggtagttatcggggagctggttcatgtataaggttaacacttccttgatttcgacctggtgggcagggctttgcaccgcgttttgaaacaggcttccgatcatatcgtcagaaatcgtcacctcttttttatgctttctgacatagtcgataaacgcattgcgtgccacttgaaaaagccatggcttcaccttgctgtggtcgtaagaatggatgtgtatgtaagctctcataaaggtttcctgaagcaaatcctctgctagatgtttatctttcgtcatggagagcaggaacctgtaaacatcattcatatacatttggtaaatttcgtcgatagtcactgccttttctcccctctatgttataaacgcataagaaaggtttgaagttgcactaaatatgcccacggctcatttttcctccaatttcttacctttaaaaatcatctatcctatataataactgaacacgttcaaaaaaactaatcttcatgatgtaaagcggccgaaatataaaacacagcaacaaaataagcctttagcatatgaatctttattttatgctaaaaggcttatttttttgaggatatccttcatttaagaggtgcgggtaagctgttttgatcgtctgtcaaaagtaacggtcatgagcgcggtgtccttccgcggccagcgcatcggctttcgttcgatggacggtgccgaatggatggttgggcggagcatagatcgaataaagtttaagcggagtattgcctgtattggtgagattgtgccatgttccggcagggacgacgatagcggtgtcatcatatacatttcttctaaatggcaaatgatgtttgctcggccccatctgaacaattcccctgcctagttcaacacgaaggaactgatcgacgtgaggatgcatttccaatccgatgtcttcgcctgggttgaggctcatcagggtaacttgcaaatgccttcctgtccataaagcggtgcgaaacgttttgttctgctttgccgcttcattgatgttagaggcaaacggtttttgtccataatctcttaacacgatacgttcttcggtgccgggtgttcgaaaagcgcctgcataccctgatccgtgaaaccgtccggcgctgtaaggcgaaggaaggtgataaggaaattgatatggatgcatatgtttttaggtctcctcattagctttattaacatcaacgtatgcaataggcgtatggagcgtgcctagtctcaattttataggcttcatggtatcagatatacaaaaagaaggagagccatggaatacaccaacatatcggaacatcgctcgaaccgtcgcgcagcggtcatcggaacatcggccatcggaggctccaagggaggaagccgattcaaacgattcatgccgcgcttgatcaagagatcaacctggttaataccgctccggcatacggtttcggaacagatcgggccaaaattcacggctccgccgacaaaagaaaaagtcaggaaaccggggaggaaaattccccggtttttttgtgaaaaatcattttttagtaccaggtaataaaaaaaattgttataataataaagggaaacctcattcgactacatcaataaaggaagtgccatatgtatcaatttactggttatgctgcaaaagcgattctttctttgcgcggcggaattaaagtatacaataaagaaaatcttcctaaagacacaggtttcgttattgcctgcacacatgcaggatgggtggatgtcgtcgcactgggtgtcggcattttgcctatggaaattcattacatggcgaaaaaagagctttttgaaaataaattaagcggttcttttctttcaagcatcaacgcttttcccgtcgacagggaaaatcccgggccaagcagcatcaaaaccccgatcaagctgttgaaagaaggaaaaatcgtcggcattttcccaagcggaacgagatcatctgaagacgttccattgaaaagaggggctgtcacgatcgcccagatgggaaaagcgccgcttgtgccggctgcatacagcggcccttccaacggaaaagagcttttcaagagaggcaaaatgaaactgatcatcggcgaaccgctcaatcaggaagatttcgctcaatactcgtcaaaagaaaagctggtcaaaatgacggaggctttgaatgacagtattaaagctttggagaaaaagctggagcagctataattcaaacatacgcagggaaaaacagcttctcatgcacagagaggctgttttttttatttttctaaaattcaccttgcactccatttttatgataaaatagcagcgtttttattttttatgcagtatgttagaactatggttattggtggaggagctcatacatgaaatggtatttgaaagcaataaaaaactatgcaggatttacgggaagggcgaggcgaaaggaattttggctgttttgccttttctcatacatggttctggtcatctacggtttttttaaagccattctgcatcttccggaatatgaaatagagacatttttaggaatggtttatttgctcgccaaccttgtgccgggcttggccgtcacgatccgcagattgcatgatacagggaaaagcggattctggatctttatcggtttaattcctctcattggaaagatcattttgctcattatgctttgtcaagacagtgaaaaaggggaaaatcaatacgggccgaacccgaagacagcgctctaagcgaaaaccgcctgaggacaggcggtttttttaattgccgggtgcagttgctttttctaaaaacaaaagcagttcctgccaaaatgtttgagctgcaatggcatcgtattcagtttttccgccataggctatttttctgctttttcttccggatgtcggaaagtatggaggcctgatattatgaccggctttttcaaaatacagatgtttaacagaataagagaatctgttctttttcagccgttcttcgattttctcgttcattgaggcagagggccatactaaatcgtcagtgcttgaagttaacagtataggacctttaataagttccgctttaatgattgcaggatgatcatctttcacttttcgtaaagccttttggtaaagatcaagaaaagcatgaggctgtcttgtgagcttatgtttcatcatattccacagctgaggaagcgaaaacatcggcagcggtgcaaaggcgagcggtgcgccgttcaggctccaggaagatgtctgccggaatttttttaatccaaccccttgaaagacgactccgccgcctacatgagaaacgacaaagcggatttcaggaaaatgagaacctattaacagcgccagttcgccgccttttgaccgtccgcatattccgatctgacgatgatgaagtccttcctggcgaccgagccaatcgatcgctttttgaaagtattcaagcggaatttcaaccagttttttaggcagctgtttgtattgaaaataagggattgcaagtgttgcgtatccgtaatttgctaacatgcctgccattgtttcgtcaaggccgccgtcagatccccctaatataatgattgcgggagggcggttaacggcaagcgggcgaaaaaaagtgccgcacaacccatcttcgtttacttccagtctatcaactgtttcagaaagcagcactcgttttatttctttactcaagatgatgcgttctttttgcttcacttcaatacggtaaacggacggatgaaccgattttttgtaaaatgagcaggaagattcaacagcctgcattgaccaaaaaagccccatttgatctttagactgataggttccttttagtggggctgctgatgcaggggcgacttctcctaatctattcgcttgaaaaacagcgtgtgatctccactctgcgtcagcttcatctttcactgtaacgatgatatcaatgatgtcaaacggttgaagtccgcttatcttcaagtttattttttcatcccatttggaaactgcaggtatgtgcaaaaccggttgcaaggtaatcaagacggcacttccttttcaagttttgtgtaaaataaatcgacgcactcttcaacatagtcatcaatccgatcattgaaagactccttgaatccgggcaaatgttgaaacataatatattgattcagtaaaccgaaaaacatttggcttaacatttgaaagttgccgtctgaaatttttttttcggcgtagagctttgcaaaataagcctctaaaaagcggttgagacggcggggaatatccatgattaattcgcaaacttctttatcagatacggcgtcattaaagtaaagtaaaaaaacagtccctttttccaggttttcttttaaatacgcttttgctatcaatgagaggtcttctcgtaaatcgccggtcagtattgctttaagttctccaataaaatctccggatgcaacatgttgaataacactttcccgaaataaattctgtttatttccgaagtgtctaaaaagggttaaatgattgactcctgccttttgggcaatttctctggtggatgcggctgtatatcctttttctttaaaaagggcaagcgccgcttggattaatcgatcccttgtagattgtgttgacataagtccctcctaaaatgtaaccgattgattacatcataattgaactttgccatgtaatcaagtggttacatattttaaatgcgaaaaaaagaggatacaattcattgtatcctccggtgtgttcacaatgttattccgcttcctcgagcagcgtttccgcagctttcttcacctctacgtatgaaacgtggtggccgtcgatttcgctgatcgtgaattcaaatccctgctcggtgatcatgtcgcctttttggacgtcatatttttgcgtcaggaaccatccgccgatcgtgtcaatctcctcattgtcgagctgaatgccgagcaaatcgttgacctggttgacgagcactttgccgtcgagaatgtagtggttttcgccgattttgcggatttcattaatttcatcaatatcgaattcgtcgcggatttcgccgacgatttcttcaatgatgtcttcgaccgtcacgagtccggccgttccgccgtattcatcagaaaggatcgccatatgaacgcgctctttctgcattttcagaagcagatcgtggatcggaacggtttcgatcacatgaatgatcggattgataaactgttcaatcgtgtcttctttggagcattctccgctgatgcaggccgtcagtatttccttgacattgatgacgccgacgatgttgtccttatcaccgtcttcgacgggatagcgggtatagccttcggccttcgtgatgtcaatcatctcggcgattttcatatcatttggaaaactgacgacttctgttctcgggatcatgatttccttggcaagacggtcatcgaattcaaaaattttgttgacatatttgaactcagattgattgatttcgccgcttttgtagctttctgacagaataattcgcagctcttcctctgagtgcgccatttcattttcagaaaccgcttcaaggccaaacgctttcgtcaacagccttgctgatccgttcagcgcccagatgaatgggaacataatgcggtagaaccagatcaacggttttgcaaaaagaaaggaaacggcttccgctttttggattgcaagcgtcttcggagcgagctcgccgacaaccacatgcaaaaacgtaatcaagctgaaggcgatcacgactgaaacgatgtgtgatacagagctcggaatgctccatttaacaaatagcggttcaagcagccgggcgaccgtcggctccccgagccatccgagaccgagagccgtcaaagtgatgccgagctggcaggccgataaatattcgtctaagtgcgtaatgacttttttcaccgaaatcgctgttttgtttccttcagcaatgagctgatcaacccgcgagcttctgattctgataatcgcaaactcagacgctacgaaaaatgctgttaaagcaattaatacagcaacaaaaatcaaattaactatttccaattaggaccttcactctagcgtgagaatgaaggtaacacctcctgtttagtaaaagattaactaaagcagcagcaaaaatgactggatgaccgtcattttttcaggagaaagacggcttttcagaatcttccgttcatcgggattcagccgtttcaatctgtttatgatcacggagatattgtcattgacatgatcgatttccgttgtcaggcttccaatttcatcatcattcacagttgaagagggaaactggttttccagcctttctttaatgtcggacagggccaatctctgctgcttgcagtccataataaacttcagccgtttgagagcggcttcatcgtaataacggtagtttgaacatgatctgtcaggcgttaacagcccgagattcgtataataatcgacagtccgttttgttacgcctgcagcagctgctaattcgccaatgcgatatttctctgccccatctgcatccctcctcaaccatcacgttatagttataaaacattttaatatattagaagctgtttatacaagttaattgatcaaaaaaaggcgtaaaattgatgcgaaaacctttatttatctaaatattcgagaaaatattgttagatttaaagtttagacatttgactgactcttttttaataaagtaagataatagtatatatttggcttggaggtggttagatggggccctctgcatagtcatttttacagaacgcacatcagccttattaagggaatttgaattcatcaggaggtgactccttgtcctttgtgaaggataaggttaaatggacgatattgttagtctgataatcatcgggattctgattgcattaaccgcttttttcgtggcatcggaatttgcgattgtcagagtcagaagctcccgcattgatcagctgattgctgaaggaaacaaaaaggcggttcgcgcaaaacaagtggtgtcggatttggatgaatacctttcagcttgccagctcggcattacgattacagcactcggactcggctggatgggggagcctacggttaaaaaggtgctgcatccggtctttgaaagcttgcatgtttctggcgctgtatcgcacgctctttcagttgccattgcatttttagtgattacattcctgaacgtcgtggttggagaacttgccccaaaaaccatcgcgattcaaaaagccgaacagatgacactgtggctggcgggacctctgcactttttcaatgttgtgatgttcccgttcatttggacgctgaatgcctcagccagagtgctgaccgggttattcggtttgaagcctgcttcggaaaaggatgaatcccattcggaggaagagctgcgaatcctgttatcagaaagctacaaaagcggagaaatcaatccgtctgaatatagatacgttaataaaatctttgaattcgacaatcggatcgccaaagaaattatggtgccgcgcactgaaatcgcctccgtcccggtggatatgccgatcgatgaggccatttcggtcatgctgcaggaaaagtatacgcgctggcctgtctataaaggcgataaggatcatgtcatcggcatgatcaatacgaaacagctgtttacggatatgctcatgatgtcagaggctgagaaaaagcgattgtcccttgaagcctatgtccgtccggttattgaagtcattgaaaccgtgcctgttcaaaagctgctgatcaaaatgcagcgggagcggattcacatggcgatcttaacggatgagtacggcgggacatctggtcttgtgacggccgaggatattcttgaagaaatcgtcggggaaatcagggacgaattcgatgaagacgaaaaaccgcttatcgaaaaagtctccgatcatgaatacatcatggacggcaaagtgagaatcgatcaggtcaatgagctgtttgaagacgatctcgaggaagaggaagtcgaaacagtcggcggacttgtgctgaaagaaaacatagatatcgcggaaggccaggcggtgcatatcggctcttacacgataacggttctcgaaatggaagggcgtctgattaagcacgtcgaagttaagcgggaacaaacaacagaacatgtagagctggcaccggcaaatccggtcgtcgttaacgaagtcaccttgagcgaaaaatagctcaaggtgatttttgattttaagaaaaaagtcatttgaacaggaacttttgttcgtatataatgggaacaaacgttctgtttgagaggtgattgatttgctgtggtacgaaatcatttcggaggaagagaggaaaacgtatattaagcggatcgaatttcatttgcggaattggaaaaattacaaagccgccgtgctcaatttagaaaggaggatggagaaggagcaaaagaacgggctcaccgtcaaagaaagaaacgctgaatatcagatcgacgcggaaaaaaggctctatcaatttttgcttgattcgatggaaacggctgtctcagaattggatgagctcgagcggaagttggtggaatgccggtatattcataattggagcatgggaaaatgcgcgatggaaatcggctacagcgaaaaaacgctgtttttaatgaagaaatcgctgctggacaagctgcttgtcagcttggcggcgatcacgaatatttaacggatgcgagggcttgtctcaaacaagcccttcttttctggccgcttcagttttttttcaggttcttgacgcgatgatgacacgggagagggcagcttttcttttatgataaagacaagctttaaacagcggggaggtttgacacatgtaatgaaacaaatgccggtcattttttgagacaaacgcttcaggaaaggagaggaagaacatggatttttctgaaattgcgctcgttccgctgattacgggattggtgcatacggtaaagcttgtcggcattcagaaacgatttctccccatctgtgcaattgtcttcggcatctcgatttctctcttgtttaccgcaggggactggaaggaagatatgatgatcggaacttggcttggattgtcatcagttggattttactccggttcaaaaaacgtcttgaaaccattatcaaaggaggagattgaacatgaagatttatttggatccgggacacggcggaagtgatccgggagcatcgggaaacggtttgctggaaaaggacgtgacgcttgccattgctctcaaaatgaatgacattttattaaaagagtatgataacgcagagacgaggctgagcagaacgacagacaaaacggttacgcttcaggagcgcacagacgatgcgaattcgtggggggccgatttgtttgtctccattcatacaaacgcttttgacggcacggcgtacgggtatgaggattacatctacagcggcctgtccgatgaatcagttaccgctctttatcaacggatcattcacggcgaagtaatcaagcagaacggactcagggacaggggaatgaaaaaggcgaactttcatgttcttcgggaaacagcgatgcacgccgttttaacggagaacggctttatcgatcaccccgaagattcggcaaaaatgaaaagcgccgcctggatcgaacagactgcgcggggacatgcaaatggcatcgcgctctgcctcggcctgacgcagcgcgaattccccttgtataaagtgacgatggacggggggcaaatcggggcttaccaagaaaaagacgacgttttgaaagttatttctgcgaattgggacagctttcaaaaagcggctattgaaaaagggtagaaagggaagaatccattttgaatcattcaaaatggattcttgacatttaatgagtccgcatcttttttcatttgggcgtaatgttcctttctgaacgctcccatcagaatttgagctgctatacaaatcaataaaccagaataattggttcatcataacaccatcattttcacggaatcagcatgctgccggcccagaatccgccgattgagcctgccattgtaagcaggatgtaaaccgctgaagcctttacccgctttgcagccaaaagctgaacagcttcaacgctgaacgtcgaaaatgttgtgaagcctccgaaaaatccagttccgaccacgatagagaccgtttgattgtcaatgccgaggcttatgaatatgccgagagcgaatgagccgagaatattgatcaccatcacgctgaccggaatgcgggggcgcggaatcatcgccatgagcacattgcccagccaaaatctcaaaacggacccgattcctcccgcgatcataaaagcagctgccatcatgattgataccgctccttttctttccccgcagctccgctgacctttttgccgatcacgatccccaaaaatgcgaagcataccccgcaggcaagcgatgccatcaagtacagaactccgatgtgagcggccgattgcagcagaagtacggtttctttagaaaaagcggacattgtcgtatacccgccgcaaaaccccgtccctaagcataattggacgagcggcttttttgcccgagccgcaaaaaagcctgtcaaaaggccgagcagaaggcttccggacgtgttttcaataaaagtcggccaaggaaaaacggcggtgccgccgagcagattgactgcgtagcgcagcagcgatccgatggctcccccgataaaaacggcaacatatgatttcatactcttccttctttctcaaaaataatccgggtagtcggtaatgatcccatcgattttccagcttttgaggcggcttcccgttttctgcccgttgaccgtccaagccagcgccttcaaatcacagctgtgaatcgatttgatcagaaaagggctgatcatcgtagctttcaggctgacgtattgggcaaacgaagcgatttgccgcagccggccgcgcggcagcaatccaaatctcggcctgatcaaaacggcagtctgaatcgaaggatacatgtgatgaaacgccctcatggcgccggcgtcaaacgactggacaattgtgttcattgaacggccataccggctgatcagttgtccggccgctttttcgattccgggctgggttttggacgacttgatttcgatgagaaggcccgtcttattgtgatacttcctcagaacagcttcaagtgaagggattttttcgccttgatattcagggccgaaccagcttcctgcatccagctgttcgagctcattcatcgtatactcgcgaacgaaaccggtaccgttcgtcgttctgtcaaccttgtcatcgtggatgacggcaagttttccatcctttgtaatctgtatgtcgagttcgataaaatcagccccgagctccaccgctttttcaaaagcggcaaacgtattttctggggcgtaagccgaggctccgcgatgtgcgataatatgcaaacatgtcagctcctcttgataaaatctttccatcacaaggatacccgattttggcgatgcaagtaaatcctttgactaaagcggacaaaaggcagggggaagagatgtgcgacaaatttcggcaaaatggtacaaaagtatcatttactaaaaattctgatattttataatggacaaaaggaggcgagatgatgggtaaagggagaattaaagtggaagaacggattaagatcgaaaccgatgctgaaatgtttaaagcgactctccttgatcaaacacagtctcagaagaagaaatagcggtgttggcccgtatcacgttgtctctgggaacaataaaatagaatgatcatcaggctgccgaaggtgttcggcggccttttatgcgtggcatcggtatttttggcgtacaataaagtgagaaattttttgctcgttttagtataataaaagcttgatgagtgaaataagggagagaaagcaatgttcgaaaagtatatgacaatggatttcgctgccgatatcgggatcagcatcggtatccttcttttatttttcgcgtttagaaaaatatttacgaagtacttattcaacctgatactgaaattgacgaataagacgaaaacggactttttcaatcaggtggtgctggcgtttgaaaagccggccaggtggttttttgcgatactcggtatttatctggcgattatttattccccgttttttgaggggcatatggggatcgttcataaactgtacagagtgtccgtgattttggtcattgtaagcggcctgtataacttaacggcggcttcgtctgttttattcgataaaatcaataagcggcttgagcttgatatggatgatattcttgcgccgtttttgtccaagattctccgatttatcattgtagcgcttggaatcagcgtcatcgccggagagttcaattatgatgtcaacggatttgttgccggactcgggctcggcggattcgcttttgcccttgcggcaaaagacacagtcggaaactttttcggcggagttgtcattattatggagaagccttttacaatcggcgattggattgaaacgaaaattgtcacaggaactgttgaagatatatcgttcagaagcacgaaagtccgcacggccggagaggctctcgttaccgttcccaactctgtgctggccaacgaagcgatcatgaactggacgaaaatgcgaaagcgtcaggtcacctttacgctcgaaatcgatccgtcaaccccgcgggagaaagtcgagcggtgtgtggagcgttttaaagaaatgctcgaatcgcacgaaggggtcaacccggatgtcattatggtcaatttcgatgtcctgaaggatacgcatttaagcatcttcttcaactactatacaaatacgacggtctgggccgaaaacttggacgtcagacaggatgtgaactaccgcattcttgacattatgaaagaggagcaggttgattttgtttctccggggcacagcctctttgagttgaagaaaatgaaagatcagcaaggaaatgcttagaaacagtttttgaagggagacaagccaaatggaggaagaagccctgagatttgcggatatgatcgaaaatgccgagcgcattaccgttttgacaggcgccggtatgagcacggaatcaggcattcctgattttcgttcagccggcggcatatggacggaagatctgtcgagaatggaagcgatgagccgtgattattacgaacgatatccaaaattgttttggccgaagtttaaagagctttttcaaatgaaaatgacgggaacttatcggccgaatgacgggcacctttatttagccgaactcgagaaaagcggtaaggatgtcagggtgttcacgcagaatatcgacgggctgcatcttaaggcgggaagccgccatgtatatgaactgcacggttcgattcaaacagccgcttgcccaaaatgcggggcgcgctacggtcttgaccacattcttcaagaagaagtgccaaggtgcaatcgcgtcaatggcaaggggagagcatgcggatttatattaaaaacggatgtcgtgctgttcggcgacgccgttcagcatttcgacacgctttttgaagtcctcaacgaatccgacctgcttctggtgatcggcacttcactcgaagtggcgcctgtcaggtttgttcctgaagaagcgcacctgatccccggtttgaagaaagccatgatcaatctcgatgaaacgccttacgatcatttattcgacattgtcatcaatcaaaaaatcgccgagtttgttcggaaactcaatcattaaaaaggaagacgctccagaccggagcgtcttttttgatcttcatcacagttttttataataaaaaacggatgcatcgagccggccgtctgcagattccgcgtattcaggaatgcgtccggcttcggcaaagccgagcgaagcgtaaaggaggttggaggggtctttttcccttgtatccagcacgagaagagatctgccttcctgtttcgccctgtcgatcgctttttgcattaacgatttggcgacgccctgccgcctgaaggcgggatctgtcattaacttgcagatttccgctctgtggcggccgttttgttttgtgcataagtgcaattgaacacttcctgcgatccggccattttgtttggcaatccataaaaccgaatccggtgcgacggctgttttccagtaagcctccgccagccgcttttcgagcggaggcagaaagccgactgatgccccgtcatcgacgacgcggatgagaagctcggccaattgattggcatattccgcggttgaatgcaactcttcgattttcatttacccaccccatggtataaagataactgcatcataatcagaaaactgtttttttggcaacaagtgtgtcagataatcacactcgagggaggaaataaaaaaatccccttcatcaggggatcagacaatggatgttattcatgaacgggtgtcatggattcatcaagtgttgcaaatgaataccccatgttttttaaatttgtcagcaataacggcaatgattgaaccgttgaaggaatatcgtgcatcaggatcacgatcggctgttttgtctgccgcttttccaggatattcagctggttcatgacttccggaacgaatttttggcttctgtatttccagtccaggctgtcaatattccagtcccaataaataaatccgttctttttcagcacttttttctgcgcttcggtcagcgacggtttgcttccgtacggcgttctgatcaaatgggtttcaaccccggtgatagacttcagcgttttttgagcctgcttcatttccagattaggagaattggcgcctttataaaattgcttttggtcatgggtcaccccgtgaagtccaagtgcatggccctgctgcttcatattgagaacggcttctttgtgaagcttcatgttcggttcgagcatgaagaatgtcgctttagcatcatgttcggataaaatttgcagcagcctttggcttacggctgaaggcccatcgtcaaacgtcaaataaaccgttttttccttcgatttttctttctttttttccgcagcagctttttgcttctctttttcctgcttgcgcttttcgatctgctgttttgtgctcaagtgatcgagaagttcgccttgcgttgcttttttgagcggaacgctgtctccttcatgcctcatttggctgttttccgacaccgtaagctctcttttctcagtagcggcagaggactgtgaaaggtcccacacgtacaggagaatcagacacaacacgaaaaagcacgctgctttcgtcaacaaataagctacagatggggcagttttttttgatacttggcgcatgtcactctctccgtatcatttttctcgttccgattccattatgagatagaatgctagtctcataaaataatggatcacaatgtctaagtatacaggattggaaagaagatgaatacaggatgaagggaaaaatatatcaaattttaagagaaaatgttgaacgataaggaatgctgcttttttgatcctgaaggcggaaaaaagtttttggaaatattgcactattttgatcggcagggtcgtgttagaatggaatggagaaaattcagaagtcaacaaaaataaggggatggagaaatgaaagttctttttaacggccggctgattgaacggagcgagtgtgcggttgatattgaggacagaggctaccaatttggagacggcgtctatgaagtcatccgcatttacaatggaattttgttcacgcttgatgaacacattgcccgcttatataaaagcgcagccgaaatcggaatcgacctgtctttttcagaagccgagctgaaaagccagctgaaagagctcgtcgacatcaatcagatgcgggaaggcgggctgtatcttcaagtgacaaggggaaaagctccgaggaagcatcaatacggagcagggcttacgcctcaggtgacggcttatacatttcctattcagaagcctgaaaaagaacagcaaaacggcgtttcggctattactgcggacgacatgcgctggctgaggtgcgacattaaaagcttaaatctgttgtacaacgtcatgatcaagcaaaaagcgcatgaagcttcttcattcgaagcgatcttaattcgcgacggtttggtgacggaagggacgtcttcaaatgtttatgtcgtcaaacaaaacgctatctacacccatcctgcgacaacgctcatcttaaacggcatcacgcggatgaaagttcttcagctgtgtgaagagaacggcttgaattatgtagaaaaagcggtgacaaaggatgaattgctgaatgcggatgaagtattcatcacgtcaacgacagccgaagtcattccggtcacctcgattgacgggcaaacaatcggctccggagcgcccggaccgctcacaaaaaatgtgcagaccgctttgcaaaacagcattttgtcggaaacagccaaaacggtttaacaaagaaaaacgccgtctcctggggaaacggcgtttttttatttgcggaaaccgaacaaaatcgaaaagagcggcgataaataaaggaaaaacacaaacggcaaatattcaatgacgggaacgccgagcgctgtggacatgaacgcgccgctgactccccatgggatcatcggattaattaatgtccctccgtcttcaagtgatctcgacaaatgcttccggtcgattccaagcttgtcatacagctttttaaaggactgaccgggaatcaagatcgataaatactgttctcctgtcgccaggttcatgccgatgcttgatgaaacggttgagaacacaagccggcctttcgtatgaatgcccttgattacgccttcaagcaggcttgtaatcatgccgatcttttccatgagaccgccgagcgcgaatgcgatgatgatgagagaaacagagcccatcatcgattgaaggccgccgcgatttaaaatcttttcaacggcttcagtatcggctgagaaaaccgggccattctgcatcgctgacaaaaacgatgaaatgccggcgtcaggctgaatcagcgcggcaaaaattccggcggaaacgatccctgctgcaagcgacggaatgacgggcgtccgtctgacagcaagtacaatcacaagcagaggcgacagaagcgtgaagacgctgatgttgaccatgccttctattccgtttatgatcgcttgaatgttttcggttgaagccggtgccgccgttaaagaacggcccatgaaaaagaaaagcaaaatcgtgatcaaaagagcggggatcgtcgttcccgccatatgtctgatatgcttgaaaatcggaagctccccgactcctgcggcaaagttggtcgtgtctgacattggagacattttgtcgccgaagcaggcgccgcaaatcacggctcccgccgcccatgtcagtggaacgcctgccgccgcggccacaccgatgagggcgacgccgatcgtgctgaccgtcgtaaagctggagccgaccaatgaactgatcacaagacagctgaaaagtgcggtgagcagcaggtgctgcggttcaatcagattcaacgcgtaaaccgttaccgtcggaatcgcgccgctgtactcccagactccgattaagatgccgattaggcaaaggatgatgatcggctgaacgccatttcggatgcctgagacaatgccgctctcaagatctttccaagaatgccctttcaccgcgccgacagcggccaaaaaaccgacgcaaatcaaaagcggtatgtgcggttctgctttaaatatgaataagcaggtgaaaataataaacaatatggccataaacaatagagccgatatggaaaacgatagtcgtttttcgtttgacaaatcatacacctcattagaagaaatctctttctttaatacttttatgcttttgtgcgtaaacgtattataacagaaaaatagatcatatacttaaattaaaatatttcaaacatttttcaaaggttcgcccattctattttgaaagcgctgacttttttaagatataatagattggagaaaggcatgtatttgatacacgtttcaatatccttaagccaaaatagggggaaatgcgatgtcttgcactgttcagaaaagccggtttttacatgaggaagcgatacggtttgaaaatgatgatttagaggcagtacttgtgcccgggtggggaagcaatttgatttcattgaggtggaaggcgggcggtttgaatttgttgaaaacgcctgaaacaaaggaagaatatgacgcgaatccgtttttattcggaatccctgttctttttcctcccaaccggatcgatcacgggagatttacatatgcgggaagaacatacgagctgccgatcaatgaaaagccgctcgaaaaccacctgcacggatttctttacgataaaaagtggacggtaaaaaaaatggaggcaacagaagagcggatcatcgtgcagacgatgctggactctgatgatcatccgggcatcaaatcgatcttccctcactctttttccatcaccatcacctacacattagaaggacagcatctgaaaattgatgcgtcggctgtcaaccgcggtcaagatccgatgccgatcggattggggtatcacacatctttccgctatcctttaaacgaatcaggggataaagaaaagtgcctgtttactcttcctgcctcaaagcattggacgctgacagaccgcatgctgccgactggcgagtatcgggtgacagaggagttcaaagcgggaaaaatggcagcgggtgaaaggcttgatgatatattggcggctgagcaagaccaagaaggaaacagcaccgccgtcattgcggacagcctcgccggcattcgcgtacgctatcaatgcgacggccattttaagcactgggttgtgtttaacggtacatctgatcaggatgatctgctttgtattgagccatacacttggatgacgaatgcaccgaacgtgaaccttccgaagagtgtgaccggatttcgggatttggggccgcaggaagagctgacgatgcgaagcaaaattgaggtaggcggaatataatcgatattccgccttttaccatgagcttttatcaagcgtaaatcctgtatgggacgcttgtttgccctctctccaatccaattgaaccgtcacctcgcggccggcgatttcagcttcttcaagcccttccaaaaaagaaacggattgttcttttgaccctccgccggggaatttgcctcccgcgtaatctttcaccggcgtttcgatttgggcgttcaaaacgatttcatcaccaaactttacgaccaatttttccaaatatgtatcgtccagcttgccgcggtcgcctgtccagtagagctctccgccgaacagcgcgcggccatctatctttttgatcacggcctcccaatttccgtcggcgctttgcccgttccattttgggtattccgccatataaaaaccgatcagcctcccgccgaaataaacggcgcaaaaggccatgaaaagggaggcgatgaaaagcaccggccgcttgtattcctgtttcatattaaccaccgcctaaaaagttctgctttaatcataaagcagaacaatcggaaaaaatatattctcttaaattttaagggaacgggtgcgggtgcaggttcagctgttctggtcttaacggctcttccgcaaagccgagcttcttcggcacggtgaaaattctctcaagcccttccaggcggatgaagcgctgtccgaatgtcatcggaatcaggcccgggatgagaactttcacacaataaagtccattccgtttgataacaggggaagtctgatcaacgacgatcacttcaaggttgagactccggaaagcttcaagcaggtcgcagaggtcttcggttaaatcaaggtgtttctttctttttttaaaggcatcgtcgaatgtttgcagaggccggctttgattcagcaaaaaactgagccgctcttccgcttcgggcagtccgtacattaagctgtgatcctccatttcccgcactaaagcaggactgcggagcatctggtgatatttgctcctttcagattcaaatttgcggtcgtgcttcaacatcatgcctgccagctcatgaagggcgcttttcaccgcttttacgggatcggggtgggcgcctgcggaacaaatcagattcaatccttcccgttttctgtttttggcgatcgcccaaatgcttggaatgccgtattccatcgttgaattaaagacatgcagatcatatcccgccacacttcgcaccctctctgtcatgaggcgcaattccggatctcctgaagagtcgagatccagctgccgaagtggaagcctggcataccaggcaagcaaaaatgaatcgcgctcagccgcttctaatatgccgtggaaaatcgcttcctccaaactccctccgagtgcacagccgttcgatgtttcatagacaaagctgtcttcccgccccaggctgtaatacgcgagcgattcaggaacgagaatcggccgtttctgcagaaatgaatagccccatacccagcggagcgggcgggccggatgaaacggctgaaaaggaaaatcgggatgcgtgtattgttcggcttgatgaagcccgacttttgccgggtcgagcgcacgatcttttacattttcataggtgtcatgtacgaccgtccgtttgccgcgcggttcaatcccggaatagcgttccaaaccttctaaaatggcggttaattcgctgtcttcatacgaatggctccgcccacctaccccttcatttcccatccataaagggatattgacgatcatatcggcaaacggcagaatcgcgtcataaattttggcgttgaatatccccgttctctggtccaaatagtctttggagagcgtttgttttaagtcgtccgtgttccgcacgcgaaagctgtccgggttcgttttcaggctgggccggagcgatatccgcgcggattccggtccgtcttcgggcagatttccgcatatagggcatgtcggttccggtatgaaagcgtgcagcgaactttctagcgttttcaaattgacgatgtacagctttttttccaatcggccgcgcccgccgttcatgatggtgtcgacttctgtgcagatcaggctgaccatctggcggcagccggtctttgaagcccacggatcgcggtttatgtcattgcttttttgttccagttcaagcgtctccatgctgtcggggccggagacataccacctcatatcggcgcattttgaacatcctgactctgacggataaacgagcggcccgattaccccttccccaaaagatgcaaacccgcgaagccagggaatccctgccgcccttagcactttttcggcctcgcgatataacaaaggccgccaagcgtcgtgcagcacaagaacgaacgaagtctccgccggtattctgttctcaaaatcagacctgcggataacgttatattcagcagataattgttgtgatgcgccttcagccatcaatccttcgccaacgaccaaaatacagcgcttcatcaaggttcctcctttcgcaactgcacgcaatagattcctgctagtttttcttttaaaaatggttcaacaggcagctcatagacatacagctgcaagccccggttgtttttcaaggcggaaagcagtgttttttgcaaagcagctgaaacggggatagcaagcttcagttcaccaggctccagcagaacatccgcacctttcaaaggatctttgtctgtcagtgcccgttcgagcacttttctgagagcggatgtgatgttgagtccagaacttctgtaccagcgcccgcgaattcccgcccatgcgacagggaagccttctatgtttttccctaaaccgatttccggttggccgtacaagactgtcagcgcttttaaataaaatgcagaatgccggtcttcgattccgtccagctgaacgagggaaatcatttcttttccgctttttatccgttcgcacaaccggtgttccaggcatttctccaatccccttaatacgccttcagccagcgtttctccggtggcgatcgcgaaatctccgttattcggataagaacgggtcaaccttgatgcatacatttcaatccccgtcagcccggcttcccgccgcgcctcttgatgggtcaaaccgaccgaaaccgtctcaggcaaaagctccgcaggtccggaagagagcggatctgctgtctgaacaaagcattgtgctaatggaagctgcggcaaatgtttttcttcccacagatgaaaaatgcccgttacgggtgaggtcagttcggtgaaacattggaatagccggctttctgtttcttttccggggtgttccgaaagtttcgcttcaaggtcgcagatgagttcagccgaatccttgccgcaactgaagtccggatggggaagaaacgcatgccagccgccttcgagcgttgccaaatcaagcaggtacacttgattcttcttagataatggctcaagctccgcagctgctttcatcaattcgaacacaataacatttgccagcatgtcttttcctgccaaaggaaaggttccaagcgttcgttcttcatggagcgcagaccgatggaggcgcctccaggcagcctcgaagcggctgtctccgtgttgttggaagacagggcctgccagtccgacttgtttcagacagatgccgggtatgaatcctttgttctcttcaaggcaaaacgtttgaagatcgtggagatcatctgtgaagccgcggtcagagacatacaaaacccaatcggcagatcgcaccgcttcccgccaatgttgcgtttcggcgaagccaatctccagtccgctttctgtttgctctgatatttctgccagttcgtctaaagcatgcccggatgcatccgtcacgatcgcacggattcttgaaaaaccggaatcgatcagcgaccggaccaatttcgtgagaaaggagccagtccctgcagccaatattttggtttggcgcgacagctgaaagcggtaagcgccggaatcggcaaagctttcaataaattcgatttgggcttcatacgttttaagcactgagctttccagtttgtgcgggtgatcgcggctgacgtcgcgaacgaatccgtttttataaagcgtttctccgatttcatatactctctttcggtacggagcttgcagtccttttgtcaaatcttcaagcgaatgttccccgttgaacattggcagaagtttttcgaaccattgagcaatcgaagatccttttatgcgaaacgacccggaattatttctaaaatacgcgccgccgttcggatcaggaagaaaccatgtatcccggtttactttcaggcgagcggaagcagtcaggtgtgtcatgctcctcctcctttaatgttttaaaaacaagacataccattatatgtaattttgtttgtcctttatgctataaaagaccccctgcggcaaaagaggcaggggaagtcttcttttttataaaaaaactacatgcctccgtgccagcagctccagcagcaatgtcccgcacagctccagcagctgtgtcccgcacagctccagcagctgtgtcccgcacagctccagcagctgtgtcccatgcagctccaacagctgtgtcccgcgcagctccaacagctggcacagcttccgcagctccagcagcttgcgcagtgtttaacattggcgtgatggcggtccggatcccaatgcgtcatatcgtctgcctggaagtgatccatctccaacgactgcagttcatcatggaatggttgcattttaatatcccccttcatcgttaaaatttttgaccaaaacacagtaaaagaagaatgaaacataagcaaagtcagattaagtcaaataccccgggtactcacaagatcaaattatgaggtctgttaggtggttgttactaatttgaacgcctatttttcctgttattggattttgttggagggaggtttttattttgcggccatacttgcggcagtttattgatataaagatcgttggaggctgggagaggatgaaatcctaggctaagtagagatgtagcatcaaagaatgcaatctatgaaaataaggtattaataaaaatttgactctaaaaaaacggattcgattggtaatgaatttcaatgtagtgaaagtcgaattctcaagggaaagtcgtaaattaatgcaaaaataacttctggaaacaaacatctaaagtaaagaaagcatagagggtaaaggtagctattcggcttacggattagcaggaaaaaatcaattggcgttgtatatagcagtgaagcatcttctaaggacacagtgctcttgcagttttatgctgatgcgaatgcttatgtatcagttgctacaaaaactctttcaacaagtatgctttctaataatttgatagagaaggagagattgccttggccaatttttcaataataaatgcggttattgtattaggagtcttactattaattgtttgggggattgtctcctttattagaaattcaagaggatcataacatgatgaaaggccggacaacagaccggcctcttttaaatcgttatttcacaatcagcacggggatctccgattttgtcgatatcttgtcgctgacgctgccgaacaggagctttttcaggcggttctggtcgcgcgtacctgtgatgacgaggtcagcgccgatgttttccgcatgctgcagaactgcgttggccgtgtctccttccagcacctcgatttccgcgtcgtactggttttcgctcaatatgattttcgctgccgcaatcgcttcttccgcgctgtcctcgtagatcatgggttcaccggccaagtctgaatcgcgggggatccggggtgcggccgggaagccgctgtaaaggtatggcgctccggcagctggtctttcggccgcagcctctgttctcacttgcctcggttcatggacatgggcgacggtcaattgtgagccgagccttttcgacaggtcgatcgcttttctcagcgcttttttgctttcctcttttccgtcaaacgcgactatgatccggtcagctttaaacaaattgatcattcctttcagaatggatttactgtcatattacccgttttcccaacaaatctaacgaaatataagaatatgaatcaaaagcctgccattcgccaaaaaaacaaattgacaattaaagggccgtactataagatggaaaatattaataagattggagggtatcgtcatgattagaaatatcaatgcatcagttcaacaacaaaagcacctaaacgtgacatttccataccttccttatgctcaggaatccgtttcactctaacaattttcagaaggaaggcgcatgtcgcgtgaacaagcgtacatgcgcctttttatattaaaaaaggcatgctggtacacagtgtgccttttttttcggagaaaaaacatcctgtttccgatgcggagcagcatgtttttccaataaatcaaccgcacataaggaggaattttttatgccgagtatcagaaaaaacgaaatcaaagattgtaaggaaaaacttgaaggcggctaaaaaaggagaggatatcgatgttttctgttttatggaagctgggctggttttttaaagcctcatggcggcgctacacgatagcggtcgtcctattgattattgtaaacgtattggaaatgtttccgccgaagctgcttggcaacgcgattgacgatatgcaggcgggcactttttccaaggccggcatgctcggctatatcggtttatttcttgcgcttggcgcagttgtttataccctgtcctattattggatgtatcagctgtttgggggagcgaacctggtcgaaaaaattctcagatccaagctgatgggccatttgctgaaaatgacgccgtctttttacgagaagaaccgcacaggggatttgatggcgagggcgacaaatgatttaaaagcaatttccatgacggcgggcttcggcattttgacactggtcgattcgacgatgtatatgctgacgatccttttaacgatgggttttttgatcagctggaaactgacgcttgcttcgatcattccgcttccgctgatggccgccgccatcagcatctacgggaaaaaaattcatgagcgtttcacggaagcgcaggatgcgtttggcgctttaaatgatcaagtgctcgagtccgtgtcaggggtaagggtgatccgggcctatgtacaggagaaaaatgatgtcagccggttcaacagcatgacggctgatgtgtacaagaaaaatatgaaagtcgctttgatcgattcgctgtttgaaccgacggtgaagcttttggtcgggatcagctatttaatcggtcttggctacggcgcctatcttgttttccgcagccagctgacattgggtgaactcgtctctttcaacgtgtacctcggcatgctgatctggccgatgtttgcgatcggagagctgatcaatgtcatgcagaggggaaatgcttcgcttgacagggtaaatgaaacattggcatatgagcctgatgtgagagagcccgctgaacccgaagcagcggagccgggcgatattgtgtttgacggggtcacttttacgtatccgagctctgcgtcggaaaacctggccgatatttcatttaccgtattagaaggacagacggtcggaatcgtcggaaagacggggagcggcaaaacgacattagtcaagcagctgctgaggcagtatccgcaaggaaaaggaacgatcaccatttcgggcgtgcccattgaacgtctgccgcttgatcagctccgcagctggatcgggtatgtgccacaggaccacgtgctgttttcaaaatcagtgaaagacaatattttgttcggcggacacctcgctgaagaacgcgatttgcacgccgtcatctctgcagcacatctgaaaaaggatattgagatgctttcagacggcttggagacaatggtcggagagaagggagtcgctttatccggggggcagaaacagcggatttcaattgcgagagcgatgattgcggagccccatattttaattttggatgattcgctgtccgctgtcgacgcgaaaacggaagcggcgattattgaaaacatccgcagcagacggaaaggcaaaacgacgtttattacatcacaccggatgtcggctgtcgaacacgccgatttcattctcgtcatggaggatggaaggatcgttgagagagggacgcatcaagaactgatcggccggaaaggctggtattttgaacaatatgaagcacagcagcttccttcgggagaagaagggggcactgtagcatgacaacaggaaaaaggcttttccaatatgcgcttctttataaaaaaattctcatctgggcgctcgtcatgctgacgatcgccgtcacagccgagctgactgggccgatgatcgccaaaaagatgatcgacgatcatattctcggaattgaaaaaacgtggtatgaaacgacagagaactcgaaatatactgtttcctacaaaggaaaggaatatatcagggaagacaggacagacccttcagctgaaaagctgcaggaagttcacatctttcaagtcggtatgaactactactttgtggggaaaccggtttcctttgacggggagcggacggtttccgggggagagctgagaatgacgagcggagaccggacggaaacctacaaggccgatcgcctgtctttgtctgaagtgtatgctttttacgagcctgaaataggagggctgatctcgctcgtttctatttatttcggccttctcattttctcgatctttttccattacggccaattctacctcttgcagatgagcgcaaaccgcatcattcaaaagatgagacaggatgtattcgccaacattcaaaggcttcctatccgctattttgataatttgccggcaggaaaaatcgttgcaagggtaacgaatgataccgaagcgatccgcgatctgtatgtgaccgttctttcgacgtttgttacaaatatcatttatatggccggaatattcgccgcactgtttttccttgatgtcaggctggccggcgtctgtctgttgattgtgcccctgattgtcatttgggctgctgtttatcgaaaattcgcttcaggctacaatcataaacttaggtcaatcaacagcgagatcaacgccaaaatgaatgaatcgattcaaggcatgacgattattcaggcattccggcgcggacaggacacaaaagaagaatttgaacagctgaatgacagccactttcattaccaaaataaaatgctgaaattaaactcgcttatgtcccacaacttggtcaacattctgagaaatgtgatgttcaccgctctaatatggtatttcgggggagctgccctgaacgcggaaggaatgatttcaatcggcgtactctatgcattcgtcgattacttgaatcgtttatttcagccgattacgggcatcgtcaaccagtttgccaagcttgaattggcgcgcgtatcatcggagcgggttttccgcctgctggatgagccgggcgtcgatgtcaaagagccgagcagcgaaagagcgcgggggcgagtcgtgtttgaggatgtatcatttcgctatcatgacggtgaagatgtgctgaaaaacatctcttttgaagcgaagcaaggggagaccgttgcattggtcgggcatacgggctcaggcaaaagctcaatcatgaatgttcttttccgcttttacgatattgaaaagggcgatgtcaaaatcgacggcagaagcatatatgatatgtcaaggcaggaaatcagaaagcatatgggcatcgttctccaggatccttacttattttccggcacgattgcttcaaatgtcagccttgacaatgctgatattactagagagcaaatagaagacgccttgaaacaggtcggggctcttgaggtgctcgcccgtctgccgaaaggccttgacgagccggtcatcgaaaaaggaagcaccctttcttcaggagaaaggcagctgatctcgtttgcccgtgcgctggcatacgatccggctattcttattttagacgaggcgacggcccatatcgataccgaaacagaagcggtcattcaaaaagcgcttgacgtcgtcaaacaagggcgcacaacctttatcatcgcccacaggctgtcaacgatcaaaaacgccgaccagattctggtgcttgaaaaaggccggattatcgaaaggggaaatcatgaagagctgatgaagcaaaaaggccaatactatcaaatgtatgaactgcaaaaggggaaaggaaccctgatagggtaagccggatcttcacccggccttaataagcgagccccaccctcgccttgacaaactggtcagactctagctgtgtaaaaagaaaatgggcggtgtcgccggtggatatttctcttccgccgggcggcagaacatcctgttcaaaacggtatgtcttcaatgccggcccatcggggagatacgtcgggcagacgatcgtccaatccagatcagattcgcggagccgttcgtacacacgggcatgttcttgagctgcgcgcgtagagcgccgttttgattcgtttgtttcaaagcggtaaagggccgggttctgccttgcgtttaaaatgccggcggttccgatggtaatcagccgtttgatccgatgtacgttcatggcgtttatgatgtgttcgatggagacggtcaatgtatcgtctccatctgtgtttaaacagctgacaacgatatcgcaatcttttattaaagactcgacgtcatgccggttcctggcgtttcctatatgtgcttggcataaatccggaatgcgggcgccttccgtcctccggacaagtgcgttaacggaatggtgcccatcctcttcaacaaaattgagaaaggcctgtccgacacggcctgtacctccaaaaagcgcaatcttcaacatgatcactcccatcggatctatcatacgtcagatcgtccggaagaaaaagccccgcgtaaacaaaaggttccatgataaggacggacatttgagacatactcattcaatagagaaatcccgacaaattgaatcaattcccaattgatgctcaacatcagctgcatgccgacccctcctttataccagcatatgaaaaaaggagaagcgggtgcgggctttcacaagatatgccagaggggaggcccccgtgatggtaatgaatgagaaggtttgccgaaaagctaaagaaggtgcagtatatgcaccttctgttatccatgaatatgaagttgtttaaaattgttgaccgcccatagatgcttgagcttgggaaactaaacgttttgtaatttctccgccgacagaaccgtttgcacgggaagtcgtgtcagcgccaaggtttacgccgaactcagaagcgatttcgaatttcatttgttcgatcgcttgcgctgctcctgggacaagcagttgatttgaagaattttgattagccatttgtcatcaaactcctttataaaaatggtatggttgggctgactggagttgcaccagctgacggcttccaccgatagaaaaccgctgccttctcggctaaagcccaatgttggtttgtactacgtattatggtggattcaataaaataaatgcgcgtttcaatctggtaaatgttgaaagacgaaaaggttatgattggggcaagctaaggaaaaaagccaggaggatgaagaagatgatgtgtccagtgtgcaacgggattctcgtccagacgaggcattgtccgaagtgcggcggggaaatggcggacgccgggagagcaaccgattttttcggtccttacagtccgtacatggagttcgattcatttaaacaaacgcaaaccgcgtgcgttcatttatatacgtgccaagactgcacttatgaagaaaccgttgaaattgaaacgaccgaagcatagctgcatagagagccgcagcatgcttcggtcatgtttgaaactgtgttatccttcagagcggatgcggagctccgtttctttatcaaaaaagtgagctttattcatgtcaagcgccagtggaatcgtatcgccggcctgaacgtcggtccttgaatcgactctggcgataaacggctgagtgccggcctgcgaataaagcatcgtttccgcgcccatcagctcggctacctcaattttcgcatcgactttcgagtcttttgacgcttcaatgaaaacaggttcatcatggatatcttcaggcctgattcccatgatgatttccttgccgacataaccctggccgcgcagaactttcatttttccttccggcacgcgaaccgaaacgccgtcgaatgtaaacatgtcttctttcagagtgccggtaaagaagttcattgcaggagacccgataaagccgccgacaaacacgttttccggattttcgtagacttccttcggcgccccgacctgctggatgattccgtctttcatgacgacgagccgcgtagccatcgtcatcgcttccgtctggtcgtgggtgacatagatggtcgtcgtctgcagacgctgatgaagctttgtgatttccgcgcgcatttgtacgcgcaatttggcatcaaggtttgatagcggctcatccatcaagaacacctttgcatcccgaacaattgcccggcctaaggcgacgcgctggcgctgtccgccggaaagcgcttttggctttctatccaaatattgttcaaggcccagaattttggccgcttcatggacacgccgtttgatttcatccttcggaaacttccgcagcttcaagccgaaagccatattgtcatagacgttcatgtgcggatacagggcatagttttggaataccatcgcaatgtcgcggtctttaggagcgacatcattcatccgtttgccgtcgattgtgaattcgccatccgtaatttcctcaaggcctgcgatcattctgagcgttgtcgacttgccgcagcctgacggtccgacaaagacgataaattccttatcctcgatatgaagattaaaattatccacagccgtaactttgttgtcatacactttgtatatccgatcgagcacgagttccgccattttttctccccctcttttatgtaagcgctttaactgatttaagtttataaaaaacggcagggcggtgtaaatggacatggtgcacaatttcttttcgtgcatattgctgaagccgctaaaggagatgcatcatcaaataaacagcggctgcttcttcaaactgtctgatgtcaattgcagtccgttcgataaatttatcaattctgtactgcaggctgtttcggtggataaacaaacgtttggctgtaagagaggcattcaggttgcatctcatatacgttttgatggtcagggatgtctcgggatcagacagcgcttctcttacggcgtccgaaaatgaagaagcatgaacccgctccggttttgccgtcaaaaaagacgggaggcactggcaaaacgtggcgacgtttccgatgtcacccgcttccagcatgtaatgaaacatttgtttttcaaagcggattttgccttgaagcgatccgttgactggatgaagctggccgctgaaaaacacaggagttgccatgaaatcgcttgtcagtgcatccgcaagctcggacagctctttttttgcgagaaacggtgaaggattttcgtggacgataacggcttcatgccggtcgtaccatacaacaagcgggtctttaaaaaagccgctgaccgcttctttaatcgcctgtctttcttcaggggcatgctccattttaaaaaaatggccttgaatcagctgaatgtttcccgggttttggaggggggcatcgcaaaagaaatattcgtgccattctttctcccgctttgtcagctgctgcggacgatgcggttctgaaaaaggccggaataggcaatagagcagctctttttcccggtcggtgaccgcgcttttcaaaacgccgaaagtttcgccttcgtcggtttgaaaccataatgcatcgtgctttgaaacagccttagatccaaccatccgttcaccgtaaagcgtctttaatttctccagcatacgtcaacgtccttttctttactcgtaaatatggaagagcattaattcatgaatttcgcttttcagggaaggctcgtcatcatgcgggggataggtgctgccccactcgatttcccccgatttatgataaattccttcataatgaatccctttatgataaaacgatattttccagccgggaagcctttcttttttaaacagcggcttccattgaaagtgagaaatcattaacgccacgctccttcattgatttcaggtgggcaaaatccagcgagcagactaaacgttgatttgttatcattgtatctcattcacagaaaagatcatagattcttttcaaatggagattttcaaaaaaataccgtgaagaagcagattcttcacggcttgaggtcatgccacatgtcctccggattaaggattgactgttcggttaaataagaagcatattcaaagcttcttttcttcgttaagcggctgacagatgccagacggggatgggagaagattcctcggccgggccgggagttggcttcaaacagccacacctttcccgaacggtccaatcccaggtcaaagccgatttctccgatgaaaccgtcaagcttttcgtcaaggacccggctgagaaggaccgccgcttttgtcagcttttgcagagtgtgaagcctttcctgaggatcatcataaatctctgcaagtgttttcacggcgccgccgctcgacatatgggttgtaattccgtcctttccagcgattttggccgcgatggctgtgacggtccattgaccttttccgtttttgtttgtatgaaccctgaaatctgccgggtgatgatccacttcgatccgttcgatgccttgctgggcaagataagaagtatgtttgtgaagcatctgccattcttttaaacattcagcagcggacgaaaaagatgtgacgccttcggcatgtctggcaagaataccgttttcttcccgttttgaaagctggaatatgcctttgccgaaactgccgccggcgggctttacataaatgaagccgtattggtcgatcatgtcttcgattttatcggcatcgggctccaatgccgaaaatggaagcaattccgctgtcctctcgtcttgctgcagacattcatagatctcccatttattaaagaagcccggattgaaccacggaatgcggtattcatccataagccgtttttttgtttcccgcaaggcggaggattcttcggctttgcggttcggcagtctgtcgtatacaacattaggcagcgggactatggcctcctcccagccgttttccctgaaaatgagagcctgcaccgtgccttcttcccaattaatctggtgcgccccgaacagatagctgtagcctcctgccgggagatccatcgtcaaaagcttcgaaaaaaataaagaccttcctctgacaggatccagctgcgattttgtgaaaccggcggtgaaaatcccgattaaaggcccgatatagacggtattgtcgcgaaaaagcagggaggctttgccgcggtacggaatccgcaggtttttgtacagattttcggataataaaacggtgcgcttcaaatggctgtcaaatgagacatggcaccgttcaacactcgtaccgaaagcggcgaataacagaccgtcctgtttgaaagaagcgggcaggagcatcgtgttttcactcgtctggtggatgccgaccgtcagcggttgaccggtcatcttttctcagcccctttcgcgccggctgaagccgttaagaatgagcagtactccaaaggacctttatacaaaagctcccttttttcaggagagtgcttgataaaagcgtgttttccgggctttgagttgacatccagcagccagacttttccgtcttttgtcaggcagatatcaaggccgagctcgaataatggcccgtgatttgattcaagcgccaggggaacggcctgcgccattgtctctaaatcatcgagaaggacggcctggcgctttttcggcacggataaaagccagctgtcaaagctcaccgcctcagagccaccggccaggtttgcaagcagtccatgctgatagctccgccttaccgttttaccggctgtttcccattcgccatagccgtttttctgtagcagcaatctgatatcacaaggaaaaccgtccttgtcttgaatatcgaggaacgattgcagcagatagcggtgctgaagaactttttggcaccacgtttcaaatgaggcctgtttcgaaaatgatttcagctgtttgtgttttccggtttggtaggctgcctttaccgtttttcccgtaagctcaagatgaatgatgccgcggcctcctgatccggatgcaggcttcaagatgcatgatttttcttttgcaagcttgcgcaggatatcctgggcattttctgcaatcgttgttgcaggaaggtaggacttgatgacgggatcggctttcaatgctttgtaaaccgtccatttgtcaggaagtccaagtcctaaaaatgtcgttttaggatactttttgagccattcgacaatcggttttgcttttttcgattgctgatctctgccgtaaaagcagcggtcatagatcaattccgggatttctctttcaatttcattccactgtcctgacttcgggtgaaaggagagccctttcacaagcagggaaccgggggaaatatccaggggggtgaaccggataaatcggattccgtagtccgaagccactttggccagttcttcggcataggctttttcatgtccgtgcgacagcgacataaatccaagcgtgatcatgattatacctccttcatgaaaaacaaggcttaacaggctgagactgtcaaacttcgggcaaactttaatatatagacttctgtttcatgatacgcttgagattgcagaaataggcttttgtaaattggaaatgattaaaaattttagagcgccctttatacaattgccatctgacccattgtattttgaagcggcttgatccattccgttatttgcccgtcttttattcagctactataataacgttaggcaagacggtgaggatcatcgtcaagacacacgctgtacagctatgatgtcaggtaaaaaggaaggcagttgaaaagaacatgtatgtatttggaatttttgccgttatgattgcagtcggtgcacttatcggcgctgtaacgaatcattttgcgattaaaatgctttttcgcccctataaagcgatctacatatttggaaagcgggtaccttttacgcccggattaattccgaaaaggcgcgatgaattggcgagacagatgggacagatggtcacaggccatctgctgactacagaagggctcaaaaaaaggcttgcatccgatgcggtcaaaagccaggcggtgcaggttggagagaggcttttggcccgcctctcgcaatcaacggccaccgttgaagaagcattggaaagcatcgggatttcaaaccccgcccaaaaagcggatcgagcggtatccagattggcggatgagaagctgtccgcatttttagaggcgtatgagaatgaaccgctgaaaaagcttttccctcttgaggctcaagaaaagctgaaagaaaaaattccgatggtgtccagctatattttaagccgggctgtcagctactttgaaagcgatgaaggcaaggaacgcctcggacatatgattgacgattttttgaaagaacggggcatgctcggcagcatggtgcagatgtttttaggcaacagcagtctggttgaccgggttcagccggagattgtgaagtttttaaagaacggcgagaccgcggggcttttacaggatctgcttgaaaacgaatgggacaagctgaaagaatatacgttcaaggaagcagatgacaaatggaacctcaaacctctcattttcgatttgaaggaaaagcttttgaaacgattctcgcttcagccgtttttcgaaaagacgataggctcctctatttccagttttgagcaggatatcgctttgcgccttccgcagatggccgaccgccttctggaagaagcgggccgccgccttgatcaagcgctcaaacagctggaactcgagcaaatcgtcaaggaacaggtggacaacttccccgttgaacgtcttgaagaaatggtgctgtccatttccaagcgggagtttaagatgatcacgtatttaggcggcctgcttggcggaatcatcggagcggtgcaagccatctttgtgattttgatctgaggctgaagacggcctgttcatacggaattatcgtataactgtgaaaaacactccatagtttgttatagtggagtggtgccgattccataagaagaatacgggcaggaaaggagcggatcaatatgacggtcaatttacatgactcggcttatgacttggaacaagcattgcgtcaaagcgaagaatattcccgattgaaaaatctttatgatgaggtgaatggcgacccatctgctaaaaagatgtttgataactttcgcgatattcaattgaaccttcagcaaaaacagatgaacggcgaagacatcacccaggaagaggtcgaacaagcgcaaaaatccgtggcgctcgtccagcagcatgagaaaatctcgcagctgatggaagcagaacagcggatgagcatgctgattgctgatttaaacaaaatcattatgaagcctttggaagagctttacggaaatccggagagctgataaaaaatcccctcttgtcttgacaagaggggattttttcactaagtgaacaaataatgttcataaagatttaaaaaagacttgtcaatttgtgaaatagttgcgataatactaaatgtaagtgctttcatttttgccgggatacgatcatgaaaaacggactggcggcaaaatgataaggggtacagaggaatttgacagattgaaagcaccgtctgctggtcaaataaaggggttgtcaatatacggtgaattgaacgaaaggggcgttgaattcactgttttgaatatgagggagaatcatgatcgtatccacaagatgcgaagtaaaaagtctgtgaaaacaggctttttttagtatgtgcatcaagagggctgttctaaaaaaagggaccgggacatatcctctataacagattcagtcatcaaagaagggggacctcctggtgtcaaaacaaatgcttgcgctgaatatagacggaacgctgcttcggacaaacggacggcttcatcccgcaacgaaggaagcgatcgaatatgcaaagaagaaaggtgtatatgttacgcttgtgacgaacagacattttcgctccgctcaaaaaattgccaaatctttaaagctggatacgaagctgattacgcacagcggagccatcatagcggaaaaaatcgacgatcctttattagaaaaaaggatttctgaagaacagacatttaaccttgttcaaatactggaaagctatgattgcaatatcagaatcctccatgaaaaatattcgattggaaaccggaaaaaaacgaattcaaacctgctggggaaaacgatgattcacccgtctgacccgattttttatcccgtccagtttgtcgattcgctgagcgacatgctgatggatgaaccggtcagcgcaccggtgatcgaggtttattgctcaacaggacagtccgaagaaatcaggcagacgatcacaaatgcatttcctctcgtcgacatcattggagcgggggaaaaaatgctgattgtccataaaggggtttcgaaagaagcgggtttgacgatgctcgccgccgacctcggtctaaaaatggaagatgtcgttgcgatcggccatgaaatcgacgaccttccgatgatcgagcttgccgggctcggagtcgcaatgggcaatgcccctcaggaggtcaagcaaaaagcggattgggtgacgcgctccaatgatgaacagggcgtcgcttatatgattaaagaatacttcagaatgcagcaaagcaaagggtttcttaaaaaattccatattaaaaaagtctgattcttatagaatccccgctttcaacttgaatgcggggattattcattcatccctgccctgtaggaatgtttgtttcccggattgattttggccatttatttttgtacactaaagaaagttttgaaacgaaaaaggtgatgacattgcgcatttatatagaagggctccaagatgaaaggttccagagaccgcttgagcatatagccaacttattctttgaagaaagcgaagtcgtttttggcgaagaagcgccggcagaccttgcgatcgttctcggctacgaccgggaagagaacggcgtcaaggcttcgggtatgataaaagatacggacattagagcagaatatacgaaaaacattgaccccaaactgacggaaaaggaagcgtttaagcaggtgaagaataccgtttcctacgtttttttgagcatgcttcaggagcataccggaatcattcagaaatgggggattctcaccggtgttcgtccgacaaagctgcttcataaaaagctggagagcggcatgccaaaggaagaggcgcatgccgagctgaagcgggattatttagttcacgacgaaaagatcgaactgatgcaaaacatcattgaccgtcagctgaaagcggtacccgatttgtatgagctgagtcaagaggtcagcatttacatcggcatcccgttctgcccgacgaagtgcgcctactgtacgtttccggcgtatgcgatcagaggacaagccggacgggtcggctcatttttgtgggggcttcactatgagatgcaaaaaatcggcgaatggctcaaggagaacgatgtcagaataacgaccgtgtatttcggcggcggaacgcccacaagcattaccgctgaagaaatggatctattgtatgaagaaatgtaccgttcatttcccgatgtgaaaaacatccgcgaggttacggttgaggccgggcggcccgatacgattacagaagaaaagctcgcggtcttaaaaaaatggaacatcgaccgcatcagcattaacccgcagtcttacgaaaatgaaacgctgaaagcgatcggacgccaccataccgtggaagaaacgatcgaaaagtaccatctgtcgcgaaatgccggcatgtctaacatcaatatggatttgatcatcggccttccgggcgaaggggtaaaagagttcagaaactctctttccgaaaccgaaaaattaatgcctgaatcattgaccgtccatacgctgtcatttaagcgcgcgtctgaaatgacgaaaaacaaacataagtataaggtggctggccgcgaggagattgtcgcgatgatggatgacgctgtctcgtggacgaaacagcacggctaccatccctactatttgtacaggcagaaaaacattctcggcaacctggagaatataggatattcacttcccggccaggaaagcatctataacatcatgatcatggaggaaaaacagacgattatcgggatcggctgcggagctgcgagcaaattcgtcgatccgggaacgggaaagatcacacatttctccaacccgaaagacccgaaaacgtacaatgacagatttgaacactatacagaagaaaagcttcgctacctgtccgggctttttgacaagaatgctaaaggcagttaaaaggttcggtttaaaacgggacagtccctgggcaaaacgaaaggagacttcgccaatatcctggcgaagtctccttttctgtcatcctctttgttttgtttcggattttttccacttaaatattttgttcagtatatgaaaaatccgttttgattcttttgtcaaaagcggccccaaaattgccaggatcagtacgtacaaagcggcaaacggctttaatgtggccgaaagtccgccggcgattccgaggttggcgacaatgatcgaaaactcgccgcgtgagacaatcgttaagccgatattggatgaagctttatgagaaagtccggcccttctgcctgcgatcatgccggcgataaagttcccggccaaggtgaggatgacggcgccgattgaaagccataccgcatctcccagtgtaaacgggtcgatgctcaatccgaagctgaagaaaaacattgcaccgaagaaatcgcgaaacggtacaaccaaatgctcgatccggcttgcatgttctgtctcggaaaacacgagtccgagaagcagggcgccgattgcttcggcaacgtgaatcgtttccgaaaagccggcgacaaagaacagcagcgcaaaaatcacgataataaagacttcgtttgaacggatattaaacagccgatttaacagttttggcagcttcctggcaacgataaagaacaatatcatgtagccaaaagcgatcaaaatcgaaagcagcgccgatccgactgaagttgagtcaccaaggacgagccccgagacgacggataaataaacggcgagaaaaatatcttcgaacataatgattccgagaatcagttcggtttccggattcgctgtcctctttaggtcgacaagtactttggcgacaatcgcactcgaagaaatcgtaataaccccggcgatgatcagtacttcgagaaactcgaagcccgcgatgaacccgaacatgaggcctaaactgaagttgatcagaatataaatgcttcctccgacggtgatggaccgtcctgatttaataagctttccgatcgaaaattccagtccgagataaaagagtaaaaacaagacgcccattctgccgaaaaaggcgatgatctccgagctctcgataaacttcaagttgatgataccgatcgtcggagcgtgcgggcctacgatcatcccgagaacaattaaaaagggaatgatcgagaatttaatccgattcgcaattaaggcagcaatcgcgacaagcaagagtgcggtgccgacttcaaatactagatgatccaaagagcatcacccttcctttcgggaaagaaaagcctgcttcatttccttgaggttttttctttcaccggacaggacgagtgtatcattttcatcaagaacggaatctgccccgggattcaagaatttttcctgattctttttaatgatcgcgatgacagtgacgccgtagttttgcctgacgtcgatttcaccgagagttttgccgacggcatttgctcctttttcgattttgaaccactcgatgatcaggtcgttaaacgccatttcaatcgattcaagcgcctgcggcttatagaccattccgccgaggatggcggcgatctgccttgcttcgctgtcatcaagcgagatgttggtcacgatttcatcgggatcttcgtcgtcaaaccgatagatttctcttcttccgtcgtcatgaacgacaatcgtcattttttcatggtttctcatttctatttcaaattttttgccgatacccggcagatcactttctttaatattcaatcatatccctccaaaataaatttccccattcggctgaaaagttatgcaggtgaaaaagggaaaatcaggagaggtaattagattggtatttcacaggaatagcgcaagttttttttagaattaattcatttgattgaacctcgaatcgaggaatgaaatgagtgtagaaacgtgcgtcaaagacagaaatatttgcggctcttcctggatgattaagaaagctttttgtaaaaggggaggggttcactgcatgtgtctcaaactttgaggtgtttagagacatatggtattccgcttcgggatcaaaaacagggttttgctcctgatcggcgaatggtactgttaacatgcataaactaagcatcaacgtcaaaaatgatttaattacgcccatccccctttcctcacatgctttctataaataactatatataaacaaagaaaatcattcaactaaaaaggcttatttcagtatcaattgatcttgaaatggaaaatcattcagctgattttcacatgaaaaaaggtattgaaaataaaaggtggaattaattaagctaatatcttacaaaatcgtattcacggaggtgcaagatggaatatatcaaatggaaagacgaagacgggatttttgaaattgtactgaatcgctctgaggcgtacaatgccttgaatgaaaaaatgcttgaagaactgaatgaagctttgcgtgttgcagaggaaagcgaatcgctgcttctccttgtgagaggcagcggcaaaggattttcggcaggcggagacattaagatgatgctgtcttccggagatcaagacagctccgcccgcgtcattgacacaatttctgaaattgcggtgaagctttacagcatgccgaagatgacgacagcggctgtccacggtgcggctgcgggtctgggattgagcctcgcgctcagctgcgaccatgtactggtcgaaaaagaggcgaagctggcgatgaattttatcggcatcgggcttgttcccgacggaggcggacacttctttttagagcggagaatcggtgaaactgcggccaaagaattgatttggagcgggaaaaaattgacgggggccgaagcgcacgagcttcggatcgcagacgccgtattcagcggggactccggccgttttgcgcgcatctatcttgaaaagcttctgcacgctccgctggcagcgatgattgagacaaaaaagatctatcaggcgttgaatggaggcaggctgcagaaaacgcttgaactcgagaaaacggcccagatgaaaatgaggctgacaagcgaccatcaggaagggatccgcgcatttttagaaaagcgccagccgcaatttaaccgtcagcaagtataacaagagcggtccggcaggaaattgaccttgggaaatgatgtgcagaaacaattgtaaaaaaatttaagtttccataaaatgattcataagatacagatctgtacgaagtcttgggaggcggcgaaattgaaacagaagattccatctgaatacgttgctagaaagctgaatgattggtacaacgccattcggaaaaatcagatcgccgccagtgaatcattgaaagcggaaattttaaatgattttcaagacatggaagaaaatcaggacgtcctgctctactattcgctgcttgaattcaggcataaactgatgctcagctatttgaaaccgaaagagactgaaaatattgaaaaaaacctccgcgacttagaagaaaaagaagaccaaatgacgggtttattaaactattattactggttttttaaagggatgtatgagttcaaacaaaagcggttcgtcaaagcaatcggctgctataaaacggctgaacaaaaagtcagcgcactggaagacgaggttgaaaaagcggaattttattataagcttgcggaaatctactattatatcaaccagagatacctgtcgatcaactatgcgacgctagcttccgacatttttaaccggtatgaaacgctaaaagaaaaaaagattttctgcgattttatcattgccggtaattgggttgaatcgatgacatacggacccgcgctgaaaagcctggccaatgcgcttgaagacgccaggaaaatcaaaaacagccatttgacggcagccgctcattttaatttgggaaattgctatttccaccaagaatcgtaccgggaagcctcagatcatatggagagcgccctttccatttttgaacaggaaagttcatcatatattcccaaagtgctgtacaacttgatgtacgtccgtctcaagcaggggaaccatgccggagctgccgcctgttatgaaaaaggcatccgaagcgcggcatcgctcggggatgaagaacacgcggcaaagcttaacattctgtgcgggctgtatttagacggaggggatcagaaagccgtggaaaacggatttgattatttggagtcaaatcatttatatgctgctgttgaagagctggctttagatgcagcccagtattataatcaaattgagcggctgaaagattccattttttactatgaaaagtgcgctcaggcaagtcgaaaaatcaaaaggggagatgcgttgtatgaaagctaaactgttgttcgtcgcggtgtcgctggctgttgtgttaacgtcttcaagctttttggcagatgcggggaaagccccttccttgtatgcggacaaaatgatcacgactgacaaggaggctcgagtttaagggcatgatttcatctgagaatgagcgggctgacgcagcgaaagaatgggcgatgtatattacagtttcttgccttttcatcctgatcgtctctgtgatttgttttttcgctccggtctaccgcttgcaggatctcttgtttcgaatgtttgatgctgtcatcatctgtgtgctgacggtcaatggtctttattatctgaaaaaaaataaaggcgtcgcttgcgcatcgtttttactcggcttcatcaacatgggactgctcgttgttttgatggtccgctagtgtttggcggataaagggcaggcggcggcagcgtgaaacttttcccccgaagcgccgccttacccgtattttagtcagctgcggaaaacaatgattttaccggacgaatgtactacccggtgtgtatgctccaaaaattgcttttccttcagcattcctcttcctttctctttcgcttcttcatcatcggccgcttcaaatcgctcattcaaaagcgtttctccactagtgtcgaaaacggttacataataattttccatttctctgcccctttctcaaaatatgatctatttgtttaaaattatataaaaatcaaaaaaatcctttttaaaatggtatgactaacgtatgattgtaaattggaaggaggagttataatgctcaaaatcgatcacgttacgaaaaggttcggttcatttacagccgtaaacgatctgacgctggagattccagacaagcaaatgttcggtctgctcggcgccaacggagcagggaaaacgacgacattccgaatgatactcggccttttgaatgcgacagagggtactgtcacatggaaaggacagccgattaactacggtgtcacaaacagcatcggctatttgcccgaagagcgcggactgtacccgaagctgaaggtgaaagatcagctcgtgtacctcggacgcctgaaaggcatgaccaaacaaaatgcgctcaaggaaatggagaagtggctcgaacgcttccatattacagaatacgccgacaaaaaggttgaggagctgtccaaagggaaccagcaaaaaatccagtttatcacggccgtgctgcacaagccggagcttttgattctcgacgagccgttcagcgggctcgatccggtgaatgtcgagcttttaaaagacgcggtcatttctttgaaagacgacggcacctcgattgtattttcaagccacagaatggagcatgtcgaagagctgtgcgaacacgtctgcattttgcagcgcgggacgcctgtcgttcaagggaaattaaaagaaatcaaacgttctttcggcagaaaaaatgtcacgattcacgcggacggcgacttgagcttcttgaaagaggcggacggcatcgtcaaatggcgtgatcattccgaaggagtccgcctgcaggtcgagaatgaagaagtctctcaagagctgtttacaatgctgcaaggacgcgggtttatcagaaagtttgaacttgaagagccttctttgcatgatattttcgtcgaaaaggtaggtgcccgttatgaataagttttggattgttctttttcatacatatatcagcaagctgaaaacgaagtcgttcatcatttcaacggccatcacgcttgcgcttgtcgtgctcgtcactaatttgggatcgattatttccatgtttgacgacggcggagagggtgacaagatcgctgtcattgatcgctcaaatcagctgtacgacacgtttgcccagcaggtgaaagcactcgacaccgatgaagcgctggaagtcgagaaagcggataagccggaaaaagagcttgaaaaagacgtcagagacgaaaagctcgagggcattttaatcctggagagagataaaaaaggggtgctgaaaggaacgtataaagcgctcgatatcgctgattccacagctgtctccacgattgaacaggcgctctcgcaagcaaagatcgccgttggaacggctgaattgaacgtaccacaggaaaagctgagcgaactgtttacaccggtaaaagtcaacagtgtcgccttgaaagaaggcgcgaaaaccgaggaagagcttcaaaaggcgacagggcttgtctatgttgtgctgtttgtcatctatttttccgttttaatgtacgcttcaatgatcgcgacagaagttgcgacggaaaagtcttcccgcgtaatggaaattttaatttccagcgtgccgcctgtccagcaaatgttcgccaaactgttcggcgttgccctattaggcctgacacagcttgccgcgctccttcttgccggctatctgtcgcttcagtccagccaggaaagcggaggggatgcggctgagctggttaaaggattttttgatgtttccggcgtacctactgcaacgcttgtgtacgcggtcattttcttgatgctcggctacttcttatacgcaactcttgcggcatttctcggaagcgtcgtcagccggattgaagatgttcagcagatgatttcgccgatgatcctgttggtcgttgctggattcatgattgccatgttcggactgaatgctccggattcgacgtttattaccatcacttcattcattccgttttttgcgccgatgatcatgttcctcagagtcggcgtgcttgatattccgttttgggaagcggctctcggcatcggcatcaccgctctcacgattgtgattctcgccgtcatcggggcgagggtgtataaaggcggcgtgctcatgtacacaagcggcggcggattgaaaaatatcaaacaggcgcttcgtctgtcaaaagatcgataatgaaaaagaaaagcagcttgaaagataagctgcttttttcatgcaaatagtagaacgtgcattcgctttcaacccgtggtagaatgggagcagaatgttttatgaaaaggagcagaagattgacaaacatcactttcattcatgcggcagatctgcatctggacagtccgtttcacggcatcagccagcttcccgaggagatttatcagcggatcaaaaacagcacatttaaaagcgctgaaaatgtgtttaagcttgccattgatgaacaggccgacttcattttgcttgccggggacctgttcgacgaagcaaaccgcagtttaaaagcacagatgtttttgagaaaacaatttttaaagcttaaagagaacaacatccaagtctatgtgatttttggcaatcacgatcatctgggcggcgattggacgccgattgaatggccggacaacgtccacatcttttcagcggaagacattgaagaaaaatcgttttacaaagacggccggctcgccgcaagcatctacggctacagctatcccgagcgctcagtttatgccaataaggccgctgaaatcaaaaaaacgaccgacgcgcccttgcatatcggcatgattcatggaacgctttccggggagagcggccatgacccgtactgtcctttctcccttcaagatttaaaaaacggacagatggattattgggcgcttggacatatacataaaagacaggtcatttcagccgccgatccggcggtgatttatccgggaaacacacaatcccgccatatgaaggaaacgggggagaaaggctgctatctcgtcaatgtttgcggcggagaactgtccttcgaatttaaagccgtatcggatgtcctgtgggaaacggccagcatcgatatctccgggacaaagcagatgacagagctgatcagcctcatgcacgatgcctttcaatctttcagaaaaagaggcaagcccgcatgcgtcaagatggtatggacaggagaaacaccctcttatttggcggaaggacaggccggcatcgcggacgagatccttgacatcttccatgaagaagaacgggaggaagacgcgttcatctggcttaccgcgatcgaagatcaaaccgatgccgccttgtcgggaatcgaacgggacgcttttttccaggagcttttgcaagaaatccatgagtttcaagatttcagcctgattcttgacgatttggagcggcatccggtctttagaagacacggagagctgtttaatgaggaagacttccgggacattcgcacgcaggctgaaaaactgctgcttcatgaactgaagacattgaaaagataaggggggatgcagggtgaatatacatgcgatacatatatacggatacggtaaattcgccaatcagacattccgcctgtctccttcaaatctgcatttgatctacggactcaatgaagccgggaaaacgacgctcatgtcgtttattgaaagcgtgctgttcggttttccgaagacgaaacggtacgagccgaaaacgggcgtcatttacggggggatgcttgaggtcggacaccctgatttcggccagatccgaatcgaacggacggccggaaagcccgagcgggtcaccgtttacttggaagacggcagcacgaagccggaaggttttttaaatgagctgctgtcaggcatcgacaggcagctgtataaagcgatctactcatttgacgtgttcggccttcaggaaatccataaattcaaccgcgacaaaatcggccgttttctgctgttttcaagtctgttcggctctgatgcgatttccaagctggatgccggcctcgtgaaaaagcaggaagagctgtttaaaccgaacggaaggaagccggagctgaaccaggagcttgatcggttaaaaaggctttctgaagatttgaaaaaggcgaaagcgcgggaaggcggctattaccgtctcttaaacgaaaaaaaaggcgctgaggcgtcgataaaggaaagcggacaactgctcaaagatcttgagcatctcgtcttacaaatcgagcaggccattgagattctgccggcggccgcggaaatgcgccagctaaaagagcagctcgcatccctcggcggctcagaagaaagccgtttccccgaaggcggacttttcgagctcgaaaagctcgaatcccacctgcatccaaaagcggctcagctgaaggcgctggaagaaaaaaagcgcggtttggaacagcgcgccgccgcttttgcaccggctgaagacttcctcgagcacgaagccgaagcggaagagcttttaacggcgtatccgttttaccagtcgtataccgaaaaaatcgcgtctttgactgaacagcttcaccagataaacggacgggttcaagcggggcttgaccgcctgcaaatcgaggaatacgatatcctcaatgcggacaccacgtatgaatacgagtggaaactgcaggaaacagttcaggcatacatagagctgcgcgaactgaagcggtcgctcgacgagcggtttgagcaggcgagggctgatctggaggaagcggaacaggcccatgccgctctcagcaatgaagtgatgcccgatgatgtccgaaaacaaaaggaagaaacccttggccgccttgcgtccgccggcggtcatgccggaaggcgggaagagctgatccttcagctgtcctatctgaagcaagaacaaaaagttcggatgaaaagaagaaggaccgcttttgcgggagcgctttgcgctgcttttgcggcagcttttgcggcgctctttttcaaggagtggttcccgggcgctttgctcgcgccgattttgctgatatttgccgcttttattttaaaaaagcctgagccttccgcggcggcggcttttattcaaaaacagctggatgatattgaccacagcggttcaaaaggcggagtaagcgacagcgctttaagggaggagctgtggaaggacgaccaaacccggcagctccttatcgccaaacaagctgagctcagacagaaagaagcggaatatgaaagagcgattcaaaaattcgaagagtgggaaaaggatatccgtccgtatcaggagaagaccgagcgctatttaaaagagctgaatctttcaattgacccgtcatttttagctgatgcgtacgctttgattaaggaactcagagaggaaattttgaaaaagcgggatatcgagaaggaactgagccgccttcatgctaaaaaagcatcctttgaagcgggattgagaaagcttgtcacatccctcagccttgcgggcggaagcgtccaagagcaggtgtttcagctgaaaagcgagcttgagtcccaaaaagagaaacttcgtcaaaaacaggaagcagacgtgtctttaaagcatgcggccgaacaaatcaaagagctggcgaaagaggtggaatacttccaatctcaaattgccgaactctttcaaaaagcaggggcggacggccgtgagatgttcgtcggactggcgaagcgcgatcaagccagaaaagaactaacggctaggctcgggcagctcaaaagagagctcggcagacaggacgagaaggccgttatgctcgcctcaggccactctctggcagaactgaaaggaaagctggccgagactcaggaaaaaagagcgcgcatagaaaagcagctgacagaagaaaggcagacggcggctaatttccatgcagagctcgccagacttgaggaatcaggagcggtatcggagcttgcctatcagaccgggatgcaaaaagagcgggtcgccgaattggccaaaaagtgggcagccgtcaagctgatccggcaggcggtccaaaacaagatagatgaacataagaaggttcggcttccgaagctgttacagacggctgaaacattactgaacccattgactgccggacaatacgaaaaaatttatttttctgaaacagatgattccatgatggtcatgcggaaagacggagctcttttttgcgcacacgaactgtctcaggcgacttgtgaacagctctatttagcgatccgattcgctctggccctctcccatcaaaagaatgtcaaattgccgttccagctggatgacagctttgtccacttcgaccaagagagatttaaacaagtgctgaacattttaaaaaagctttcaggcgaagatcagcaaatcttgtattttacgtgtcatgaacatgtaagagaagctttccgcgatgaagatgtgattctgctgccttccggaatgaaaaaggtggaaggaaaggagatgactaacaaataaaagtgtgtgctataatgattttatgtaggaaaacggagggagctttatcatggcaaaaggtatcatgctgcacgaagttggcgagcaggtggatttgtacttgctcattaaatcgtcaacgaaaggaatcgcaagcaacgggaaaccgtttttaacgctgatgctgcaggatcagtccggagatatagaagcaaagctgtgggacgccaagcagcaggacgaagtgacctacggcccgcagacgatcgtgaaagtggtcggcgacattcatcattaccgcgggcggaaccagctgaagctgagaaacatcagacctgcaggcgagaacgaaaacgtcaaaatcgatgactttcttgaaactgcaccgattcccaaaaacgaaatgatggatgcggtcactcaatatatttttgaaatgaaaaacccgaatatacagcgaatcacaaggcatcttgtcaaaaaatacggcaaggaattcattgattatccggctgcgacgaaaaatcaccacgagttcgtgtcaggtctcgcgtaccatgttgtttccatgctgaacctggccaaatcggtcgcagacctgtatccgtcgctcgatcgcgaccttttatacgcaggcgtcattctgcatgaccttggaaaagtaaaagaactatccggcccggtgtccacgacatatactgtcgaagggaacctgctggggcacatatcgattatggtgacagaaattgcaaaagccgccgaagagcttcaaattgattcagaagaagtgctgattcttcagcatttgattttaagccatcacggcaaacccgaatggggcagtccgaagccgccgatggtcaaggaagcggaaattcttcactatatcgacaacattgacgcgaagatcaatatgatggacagagcgctcgaacgggttaagccgggagaatataccgaacgggtcttcgcattggataaccgttccttttataagcccgtttttcacaaataagcgtcataacttgtctcccttttgcataatgtctggtatacagtttattcaaaaaagggggaaaagccgtgctgctgtttccgtggtgggtgtacctttgcatcgtcggcattattttcagcgcctataagctgatgacgacggcaaaggaagaggaaaagattgaccaggcttttatcgaaaaagaaggccgcatttatatcgaacggatggaaaaagaaaaagcaaagcgcatgaagcgtacactggatgaagatcaagaacagcatgaaaaatcggctgacagccattccatcgcataaaaaaagctgtccgaccccaacgaggggaggacagcttttttggcgtcagctgctgctgcttgtctgagcttgacgctggtcgacttgttttttcaactctttgtcttttacttttaaatcagcatctttgacaagtttgtcaatgacggattgcagttcagtttgatcattttgcttttgttcttggacttcttttttaagctcttttttcatgtcttcatatttgccgcgttcttcgtcttttttaatgatgtgatagccgaattgggatttcacaggtccgctgatttcgccggttttcaaagcaaatgccgctttgacgaaatccttgtccatgttatcgtctttgccgacccagccgaggtcgccgcctttttcggctgtaccgtcagttgaatactcttttgcaaggtcttcgaatttttcgccttttttcagctttttctcaacttcttcagccgttttcttttctttcacaagaatgtggcttaagtggattttgcctttcaggccgtcataatattcttttacgtcatcatcggttacttttatgttatcctttgcggctttttgcatcagaagttcgtatttgatctgttctttgacgaagtcttcgcctttttggtcaatgagctggttgagctggtcacccattgattttttgtactcgttcagctttttgtcgatttctttgtcggagacatcgtatttatcatcgagtactttttgctgaacaagcatgttcagtgcgtccgctccggcattgtcttttaatgtttgataaaggtcttcttttgtaatatttccagcttttgtttccgcaacaacctcagaatctcccccgctgcatgcgctgagagccagcacgcttgtcgctgtaatcgccgcaattgcaatcttcttcataaatgcaaacactcctaatcataacagtttaaactttcctttgaattgtatcatatcatattctgacatgctgtaaaaagattttcaacagaggggcatccgtctagtcaaattttctttccgctcatacaaatatattgatcaagaaaaggaggtcaataacatgagcggaggatactcaagcggttttgctttattggtcgtgttgttcattttattaatcatcgttggtgcagcttatctgtactaaaaccttagaaaatgagaaaagaaccgtcattttttcaggcggttcttttcttttggacgatagcctaatcgtttcatgacattcgtgcatacactaatgtaacgactggggcagaggaggtgtcaatatgggcgacggttatgcaggaggtttcgctggcggctttgcgctgcttgtggtgctgttcatcttattaattattattggtgcttcttggatatgctaataaacaaaaggatagctgccggatcaatacgatcggcagctatcctttttctttacaccgtaaaggaaatctcaatgaatgatgagatcaataaaattaagatcagcacattaatcattctaaataccttatcctgccgctcttcaggaatctctctgacaaggcataaagagtttgtaagcttgtttatgttgaagacagtaaaaaccgcaaacaagatgaaataaaaaaggatgataggagatccccctctctgtttctgctccatactacattaccaaatatttattaaaaaagatagaaaatagactgaaaaaaaggaatttccaactgcctagcagctggattatttttgtattaaaatatcaaaatcgtcggcttcctgatcgacaaagcagtttttaggcgctttgatcagtttccaggcaaacagaaaatcaggcagacaatagccgaaatgaatgcttgagatgatgcagaaatagtgagcaaagctcggcatcgccgcccccgcgtaaaacaaaacaggcgtgatgaccaaaaaagggcagagaagagagacaagcatcatgtttttcggaatttctctccatgttctcattttcaaccaataaatctttttttctaactttttcttgctgatcatcggcaagatatgaagaattttatgggcgattatagccgcaaccaaaagtcctgcaaacaaaagggcatgatcgcctctctgaacagtttgcggatgaataagctgcatcgctaaatattcgggaataaaaaataaaatcattaaactgacggcagtgagcacgatgcgcatgcctccataatctttaacgagattgatggttttccagcaactcataaatgacatccttccgtttcaacaaactgttatatgaaatcctcagaataatttactcctctggatgagaaaaatcaatccctttttcgaaaaaaatttcgtcattttccaaagaatttagaagggtgtaaaaggatcagaaatctccagtgttgaactttcatcagaagggaatatcggctaaaataagagaaagggagagaagagacaaatatgaactcaatggagcaacgcctcgagcggctggaatattacatcaaactgttattgaacaatgcggatatggaagagtatccgtactataaaatattgatcgaaaagggcttatcagaggaagaagcaaaggaaacggaaaagctgtgcgaagagctctcaaaggagcttgaagcacaaaaagcgcaaggatttgtgatgttcgatcatctcctcacgctttttgccggacagttaaatgaaaaacttgaagtgcacgaaacgattttcgcccttcacagacaaggtctttacaaaccgctgatgagcgaattcatcagcattatcaggcagtacgatctggcttagtttttaagaggctcaagcggtttgtccacctctatcgattccccggcttcttttgcttcttgttttttcttcattttgccctcttcgctcgtaaattcattttcgatgtttgaaaacgatttttcgaaaatttccatgaaatcatcgccgtaaatatggcggatgatcgacatcatctcgacgatttctggaaacttcccgtacagctgatgaaggggctgagcgccttttaagacggcgttccgggtcggatcgtaagactcgaggattttaaggaaaacttcttcacctttcggagtcagctgaatgtaagtgttgcgtttgtcattcaattttttggaaaactccaggtaacctctttcctcaagcttttttgaaaaattaaacgctgtggatacgtgcatgacgccgaacttggcgatttctgaaatggatgctccgttcagctggtaggcgatccacaaaatatggtgctcgttaatgttcagatcataaggtttaatccactgctgccaatccttttctatcgacttccaaagcgccttgctaagctgtgccattctttgactgaataaaagggcttctttcaccgtatagggctcttccgctcgattcattcacttcacctgcttctctttatcttataatttctattatgccaataaaataaagattaataaagatgtaaatttacgaattttttaaaaaatccagttttacggtgtgaaatcaggattttacctaaaaaaggagcgtgaaaattttccattcacaccccttttttaaggtttatttttttcgctgagtatattagttttgtaaggttttctccagctgttttatcttttcttcgatctcagcgatttccttttttaagtcctgctgatgaggtttgatttcctcgcgccattcctggatggacgtttgcagttcgctgccgacgtctttaatgatttccgcgccttctatggcggttttgacgaattgctcttttaatgcgattccgtcgtttttcagccttttgacggtgtcttcccatttaccgcagttggctttaagctgtcctctcaagttttttcctgaagtcggcgcggtcagcaatgctgcaacaccgccgataacaccgcctacaatcagtccagctgctaaagatcggccttttgacatgtaaatcaccccggttatatttttaaagatcaggcttggcaggcgccggccttctcatgattagatattggcgtccgagccgggcaaaccgttcctcttcttagaaacttctgcatagcttgctttattttagcatacttttttaaaaaggagggagagggttgtctgtcataatcattgttttgacaattataagcgctgtgtttaccgccggctccttttattatttaaggcttctcggatattctgcatcttatccgccgaaacgcattcttaaacaaaaagcgcttttttgcacgggaagcgcagggttggcgctcctgctccttttttttattcagcttcttatataaaatatcgggcggattcccctttttttgaccatcaaaacgaaaaaaacctcttccaaaaaagatattccttttctagaagaggttcttgttttatttgacttgttcaatcagccttgaacgcttcatgatcgactgcacgatcggaaagatgaccgccatggcgatcgtgttgatcacggcagctggtaaaacgacaacagagaacagggtgatgaatccctgatttccaggcaggccgacaatgaacagtgcagccgtgaggaaaatcgttccggaaagaacggttcctgcagcagttaatccggcggcagcaagcgttttgctgttcagctttttcacaagcagaaatacgccgaagaacatcaaggctgttagcggtttgtcgatgatgttgggcagctgtcccccgggaaaagccgtcgtcaacgcggaaatgacgcctgtcacggctccgatgacgagaacattttgcagtctagggaacaaaaggattcccataaacatcatgatcagcatcatatccggcttcattccgtagaaaaaaggcggaatcacagcgtgcagcgccgctccaatggcgacaaacagggccatagccactaattcttttgttttcatgtctattctctcctcatctaggctctttttacgctttccaataatatgctcgtcatttattgcgaaagctttctagtagtatatcaaactttcgaaggaatggggaagcctttttcgccatcttccatcatcaggataaacatcagttttcttcgcggaatttcttcataaaggcagccagcttttcgcagtcttcaactgatacggcattgtaaatcgaagcgcggcagccaccgaccgaacggtgtccgccaagccctgacattttttcttcctttgcctttgcgatgaatgatgctgtcagctcatcatttttgagcgtaaaggtgacgttcatgtttgagcggctgtcttctctcgcatggccgcggtagaatccgccgctttcgtcgatcgtattgtataaaattccggccttttcgcggttgcgtttctcaatggcatcgaggcctcctttttccttgagccactccagcacgagagacagcatataaatcgcaaatgtcggaggggtattgtagagcgaatccgctttggcatgtgttgagtacttcagaattttggcaacttgctcattttccttgccgagccagtcttttttcatgatgacaacggtcacccctgacggtccgaggtttttctgagcgccggcatagatgatgtcaaattgggaaacatcgatttttctgcttaaaatatcgctggacatgtccgcgacaaccggaatcggagcgtcggggaacttttgccactgcgttccaaagatcgtattgttggaagtcaggtgaaggtaggccccgtctgccggaatctccggtacttcaggaatatagctgtacgtatcttctttgctggacgcgatgatcgatgtgtttccgaagagctttgcttcggccagcgctttttcagaccaagcgcctgtcataatgaagtgggccgttttgtctttggagagaaagttcatcggaatcattgaaaactgaaggcttgctccgccttgcagaaacatgacttcataatcatcaggtatgtccatcagttcttttaacagagctttcgctttttgatgaacggcgtcatactctttgctgcgatgggacagctccatcacggacatccccgcaccattgaaatcaagaaattcgtcttttgccttctgaagcacttctaaaggcagtgctgctggtcctgcgttaaagttcgttgtacgtatcatcacaatcgctccctgttcgtgtataaaaatataaaacaatcctatcataaaaggttccggttatacataaaaaatttgaattgtgtgaaatatagagcaatggctatttagccgtgccgggcgatctgataaatgtggagtttttttgaacgaaaaaagggcgccggcagctgccgacgcccttggacaacgtctcgattacaggtgtttgttgatggaagctgcaatgttctgcaagtcttccggtgaatagtcatccgcatgggttttccagacggctccgaatccgtctcctttgccgtagcggggaataatgtgcatgtgataatggaagacggactgtcccgctttttcgccattgttattcagaaggttcaagccgatcggctcgtattcgtctttgatggcttgcgcgattttcggaaccgcttcaaaaaactctcgtgaaacttcaggtgtcatttcgtaaatattggttttatgaacttttggaatcacaagcgtgtgtccttttgtgacttggctgatgtcgagaaaagccagcacatgttcattttcaaatacctttgcacaagggatttccccgtttatgattttgcagaaaatacagtcgctcatacttttcctcctttttccattagggaaaggttatgtataagcaacatattaccacaatttgcgcagaaacacgaaaaacaggatgaacggctccaacgttcaccctgcctgaagaaggttacgctttaatgaagaaacgttaactgccttttgcaagcaccccatttttcgtcaaaatgaagacttgtaacgcctatacatttcctgcgacaaacacctcatttgatcgtcacaccttttttatatgacgaagacgtcaaataaagcaggtgctttctcaattcagtggatgaaagaaatttctaagcttgacatgtttcatactcaggactcttgccggattttgtctttgacaaacacctcattcgccagagttgataagctttcccttcttcaagaattagaatgtcctaaggcgctttcgattattcgttttatttttacggccgaaaagcgggagggaaaacgtttcaaatacattcttgtttttggtactattaagaaaaatgcaggaaaggaacgaacgtatgtcactactgactgttaaagagttaactggagggtatacaagaaacccggtgctgcgcgatgtttcatttgcgattgaacgggagcagatcgtcgggctgatcggtttgaacggagcggggaaaagcacgacgatccggcatatcatcggcttaatggaaccgcacaaaggatctgttgaattgaacggcaaaacgttcatggacgatccggaaagctaccgttcccaatttacgtttattccggaaacgccgattttatatgaagagctgacattgaaggagcatttggagctgactgcgatggcgtacgggctttcgaaggaaacgttcgagaaaaggctgccgccgcttttgaaggaattcagaatggagaagcgtctgaaatggttcccggcccatttttcaaaaggaatgaagcagaaggttatgatcatgtgcgctttccttgtcgaacctgacctgtacattatagacgaaccgtttctcggtcttgatccgctggcgatcaatgcccttctcgagcggatgaatgaagcgaagaaaaacggctcggccgttttgatgtcgacgcatattttggcaacggcagagcgatattgcgactccttcatcattctccataacggcgaagtgcgggcgaaaggaacgcttgaagagctcagagaacagttttcgatggaagaagcgagcctcgatgacctgtatcttgaactgacgaaggaagagagctatgaatagcattctggggatttggaagacaagaattgaggagtatgtcaaagaaacaagatcatatttgaaatacatgctgaatgaccaccttgtcatcgtcatgatttttttcctcgctggagctgcgagctggtacagcaaatggctgaaagagatgcccgaaggttttccagcctattgggtgatggccgtcatcttttcgctcattttgacaggctcgtacgtccgcacgctgattaaagaagctgaccttgtctttttgctgccgcttgaagcaaagatggggccgtattttcagcaggctttccggtttagttttttgacgcagctgtttcctctggccgccgcggccctcgctttggcgccgctgtattttgaagcaagcggcaaggggttttccgcgtacctcgtcttgctgattcaactgctcgtcttaaaaggatggaacacggctatgcaatggcggatgacgtttttcggcgaaaaaaacatgagggttaccgaccggtttgtcagactgcttctcaacacgatcgggatctatttcgctttagagtcttcatacgcatttgccgcagctgtctacctgatcatggccgcactgtatgtgtattttaaggtgatcgataagaaaaaatcgtttaaatgggaactgcatattgaagacgaaatcagaagaaagcagcggttctacagaattgcgaacttattcacggacgttccccaccttagaaaacaggcgaaaagaagagcatatctcgattggatgctccggtttattccgtatgaacagagccggacatttacatatatgtacggaagggcatttatcagatcaaacgactatttcggcatcgtcgtcaggctgaccgtgatttttggcatcatcatcgcttatttttcggcatatgagtgggtatcggccgcgctcatcgtcttcaccgtattcattacaggaattcagctgacgccgctgtttgatcatttttcacacctgccactgcaggagctttatcccgtcaaagcagaagaaaaacggaagagctttttcggcctgcttcacatcgttctgagcgtccaggcgcttgttttgtctgccgctgccggagccatgatgcagtggaccgggatgctcgccggactggccggatccgcgctgcttatatttgtgattttgaagccttatttcagcagcagattgaagaaaagtgccaagagatagatgaatccttttctttttccgcaagtatgatgaaagaagaggtgagtggcgcatgaatgaaaaccagctatatttggaggaagcgacccgctggaaaatgaagtttctcagaaagccgtcgatggctgagcggatgtcgaaaggggtacagtcgaaaattaacgcccgcattcccgccaaagttcacaaggcgatgacagaaagcattaaaaagatggtcgaggctactttgctcggctcaaatttaacgacttttgacaagaaaacaggcacgctttcgctaagggaaaaagatgagctggctcagaagacaatcgctcaatatcaaaaggcggctgctgttgaagggatcggaacaggcgcgggcgggatttttctcggactggcggactttccgctcttgctcggcattaaaatgaaatgcctgtttgaattggcgtcgatttacggatacgatattaaggagaaagaagaacggatgtttcttctgtatatttttcagctcgccttttccggagaagcgcaccgaaaagaaattttccgcatgatcgaacattgggataccgaaaagcgcgaaatcgattggcaggcttttcagcaggagtaccgggactatctcgatcttgtaaagctgcttcagcttgtgcccggcttcggcgcggtcgtaggcggaacggctaactataagctgcttgggcaccttggggaaacagcgaggcacgttttccatctgagattgattcatgagacagccggatattgatgatccggctgttttttatgctatttcggttgttccattgcaggcgtttcgcggaccgcctgctctttctcctgataggagaccgcggcatttgccagcactttggctgcgatcagcatcgctttttcatcgatatcaaacttcggatggtgatggggaaacaccgcctccggatcttcaggacgggcgcctgtgaagaaaaatgtccctttgacgtgctgcaagtagtaagcgaaatcttccccgcccatttgcatgccgctttcttcaactttttcaacgccttccgtctgtttggcgatttttgcgagaaaagacgtttcttccgggtggttgcagacaggcggatagcccctttcgaaggaatagtcgcagtcagcgccatgcatgccgcatataccttttgcaacctgttcaatttcgttttcaatcaaggtgcggatttcttcattgaaggaacgcgccgttccgattaaaacggctttatcagcgattacattaaaggagttgtcggcaacaaatgaacctgtcgaaatgacagccggctgagtcggatcaagcctgcggctgacaatctgctggagggaagtgacgatctgcgatccgatcagcacggcgtcttttgttttatgaggctgtgcgccatgcccccctttgcctttaatcgtaatcgtaaaacggtctgcagcggccatgatcggtcctatccggtattgaactgttcccgtcggctctgtagcccacaaatgggtcccgaaaatcacgtcaaccccgtcaaggcagccgtcttcaatcatcggcctggctccgcccggcgaatattcctcggcatgctgatgaatgaagacgatctttccttttaaacggtccgcgtgctcattcaaaactttagcgaggacaagcagggttgccgtgtgcccgtcgtgtccgcaggcatgcatgactcccggcacagtcgatcggtaaggcgcgtctttttcatcatgaatgggcagcgcgtcaaaatcggctcgaagcgcaatgacggggccgggagatccgccttcgatgtaggcgagaactccgcctccgcctatgttggtgcggataggaataccgagcgcttcatagtaagaggcgataaatgcggctgttttcttttcttgaaaagaaagctccgggtgctgatgaaaatggcgcctcaatttgaccatttcatcgtagtgggcatcaagctggttattgatttgtcggacaaatccggatgcgctcaaaaaaattcctccttttaggaatggtaagtttttataattttatgacaattggagccgctgttcaaccttgctgtcccgtatttatagaagaaaaatggcggcaatcgttgtgacggttaatccggcagctacaggaataaagttttttctggcaagatcgaacgggtcaactttgcaaatcgctgcaactggaatgagcgcccatggcacaagcgtaccgccgccgacccaaatggctgagatttggccgagcgcagtcagaacggctggattgctgtcaaccgccgcagcaaacatcgaagcggctgatcctgcgagagaaatccccgaaaatccggatccgtcaagaccggtcaccgctcctgtgacagtgagcgcaacagcggcgatttccggagagagcggaacgctgtgggcaaaggccgagccgaggtcctgcacgatcctattagaaaaaccgggaatctctgctgtcagtactttttcaaaacccgcatcgcccaagtaaaaaaaggcggcgattggaatgacgggggcaaacactttaaagccaaactgaaatccgctaatgaaatagccggtgattttctcaagacgccggtgtttgtggacgataaaatgaatgagaatcatgacgaagactgccgttcctccgacaagcgccgtcgcttcgtccccctgcagttccaatatcagcatcgcggcgatatcccctaaaaaaatgaccggaatcaacagcgcgagccattttctggaggtctggggaggaagccactcaggctcgctttgcagctgcttactggccgctgctctattgcctttctctttccggagcatcaaaaaggctgcccccgttgtcgaaaagcccatgatcaagacgagcggaacgcttgcagacatcacttccgcaacgggcagcccggctgcatctccggtcaatttaggcgctgcctggatgatgtaatcgcctgataaagcgaaaccgtggccgaataaattcatggcgcacgctaccgccatcggggagaggccggctttcagcgcggcgggcaggaggacggcgccgaccaatgcgacagccggggagggccaaaaaaatgaagaaatgataaacattaaagctccggtgatccagtaggccaagacagggcctttcatccatttggcgatcggagtgaccattgcttcattgacgccggtctttgccagcagctcactcatcgaaacggtaaagcagatgatgaaaatagtcggaagaagttccccggcggcgtagattaagctgttaaacatgcccatcacagacgccatgactgaatgggtcgcggctaatgagatgaaaaaaatcccgacaagcgatataaaggtggtatcaagacgaagtagcataaatgcgagaatagctgcaataaagcccaaatataaaaagtgaacggacgttaattcaatttccattttccgatcccccctttaaacataacctcatacagcgtattcctgggctgtcagagtgtgaaggaagggctcatttcctcggaaataaaaaaactgcctaaaaggcagttattcgacagaatgatacgaagaaatataggatgggcgggaaaaaatcgttccgccttggttgattcctgcggaagattccttcttttggtgggcttcgctgaacgacttggagtttttccagtcttgaaatgactgttctctgtcccacagtgtcaatacgatatacgtatcgctgtctttcggcctcagcaccctgagggctttaaagccgggctgattttcgatttttccggctctgtttttaaaacgggcttcgaaaagcggccttccttccggtgtgacagggatgttgttgaggacggtgaatccggaatgttccaaagatcccgactgatcgatgatttcgtagcggtgaggagaatgaaagacgctttctccgtcggtttcgtgaaagagaatggcggaatcgtggcttttcataaataacatgttttcaagaccgtgctgtttggcgagcttttttaaaaaatcgacagttccgtatgtaatgtaaaaattcaattttatcaccccttttttgatagtataacaaaaggacgatttaaaattctatccattacccgctataaatgctgcaacataatttgaagaaaaaattcccatactagctatagaaaggaatgaggtgaccatatgagaaagagatttttcattccaatcatcattacagcggcgatattccttttatcgttaatcggatatattacgattttgttcctgggggattatgtgattgatgaaaagaaactgattttccatgcttcttctaaaatcgtcgaccataatggagaagaagtcgcaagcctctataccgaaaacagaaggcctgtttcaattgccgaggtgccggacaatgtaaaaaatgcctttatcgcggttgaagacaagcgcttttatgagcaccacggcatcgattttaaatcggttagccgtgcggtctataaagatatattagcaggaggaaaagtggaagggggaagcacgatcacccagcagctcgcaaaaaacacttttttgacaaatgacaaaacgtttttaagaaaaacgaaagaagtcattatcgctatcaatttggagcgggattacagcaaagacaagcttttggaaatgtatttgaaccagctatatttcgggcacggcgtctatggaatccaggcggcggcaaactacttttttaacaaagatgtgaaagacttgacggtcagtgagggagcggtgctggcttccattcctaaagcgccttcaacgtattcgcccattctcaatccggaaaaaagccgggagcggcgcaatgtcattctcggcatgatgaacgagcagggatatatcagctcaaaggaaaccgtcagggcccaaggcagcacattggggctccatgtgaaagaaaaatcaaaaaatccgtggcttgacagctatattgatcttgtcatgaaagaagcggaagacaaatattcgatatcgagcgaacagcttctccaaggcggatacacgatcagtgttccgctcgatgtttcgattcaaaaagcggcctacacgctgatgaagcaggacggctattttcccggcacagacaacaaagctgaagggagcgccgtttttatcgataacaggacaggcggcgtagtagccgctctcgggggacgggaatatgctccaaaaggctataacagggccaccgcccagcgccagccgggttcgacgtttaaaccgcttgccgtatacggccccgctcttgaagaaaagctgttcaagccgtattcgatgctcgaggataaacagctgtcatacggcggctactcgcctaaaaactatgacggccaatacgcgggcaaggtctcgatggtggatgcgctgacatacagcaaaaacgcgcctgctgtatggacgttaaatgagatcggaatcgaaacggtgaagccttatctcagccgtatgggcatgaacgtgccggatgaagggctggcattggggctaggcggtctggaaaaaggggtgtcgccgctcgagcttgccggggcataccggacattcgcaaattcaggacaatacaccgagccgttttttattaaaaaaatcaccgatgaaaacggggatgtcatgttccgccacgaggaaaaatcggaaaaggttttcagcaaacaaacagcgtggaacatgacgcggatgctggaggaggtcgtgaaaagcggaacgggaaaggccggtgatttttccggggagattgcaggaaaaacgggttcgaccacgtataccggaaaagagggcggaactaaagacgcctggtttgcggggtatacgcccgaagtgacgggagctgtctggatgggatacgataaaacggatgagtcccattatttaaaaggcggcagcgcttatccgacaaggctgtttaaagacattttaaaacgcaccaaccataagcctgaacggtttaaggcgcctgaaggggtaaaagatctggacaggccgatacgcctcgaagacctggaaagcgttaaagcagactattcctttacgccgatggggctgattacggtgtcattaaaatggcatgaacaagaggataaaagggttgaataccgaatatatgaaaggaaaaacggaaaagaaacgctgattgatacggttaagggaaaaggaagcttttcaatcccttatgcaaacatcttttccgatgcttcctacaaaattgttccatacaatccgcagacgaaaacagagggaaaagggactgattatgttgaaccgaaagtgtttccttcgggtcattagatacccgaaattcatcaatttcttgaacaataagtctcatgagtataccgttcaataaaaaaacggtatattggaaggagtaattttgcgaacgtatggttgcagcttgaaaggtggatatcatgatgaaaaacgacaaggcttttaatgacacattcttaaaagcatgccgaggagaaaaggccgcccatgtaccggtatggtacatgaggcaggccggaagatcacagcctgagtacagagcgctcaaggaaaagtacggtctgtttgaaattacgcatcagcccgaattgtgcgcttatgtgacaaggctgcccgtcgaacagtacgatgtcgatgcggcgatactttataaagacataatgacaccgcttccaggtattggcgttgacgtcgaaattaaaaacgggatcggccctgtcatcgatcagccgattacatctctcgcagatgttgaaaaactcggcgaactcgatccgcaagagcatattccatatgtgctggagacgatcaggctgttgacggaagaacagctgaacgttccgctgatcggttttacaggggcgccctttacattggccagctatatgatcgaaggcggcccgtccaaaaactacaataaaacaaaagcgtttatgtacagccagcctgctgcatgggatcttttgatgaaaaagctcgggaagatggcggctgtatacgttaaagctcaaatccgcgccggcgccaaagccatccaggtgttcgattcctgggtcggcgcgctgaacgccggtgattactgccgctacatcaaaccgacgatggacgttcttttcaaagagttgaaaaaagaagacgtgccgctgattatgttcggggtcggcgcaagccacctcgcgactgaatggcacgatcttgacctcgacgtcgtcgggctggattggcggatgagcgtacaggaagccagggataaagggctgacaaaaacgctccagggaaatttggatccttcgatcctgcttgccccgtgggaagtcatcgaagaaaggacgaaagccattctcgatcagggcatgcagacggaccggtttattttcaacctcggacacgggatctttccagaagtgagtcccgacacactgaaaaaattgacggcatttgttcatgagtattccgcctcaaaaaaatcgagcctgatcacatgagcatttcagttggtcttttcaatataaactgtcaaaatacgtatagatcatgatctttaaagaggtgttcacgttgggtaaaaagaaaatggggcttcttgtcatggcatatgggacgccgtacaaagaggaagacattgaacgttattatacacatatcagaagaggcagaaagcctgagcctgacatgcttcaggacttaaaagaccgctataaggcgatcggaggaatttctccgcttgcaaagatcacgcaggagcagacgaagcagctggaaaaacgcttaaacgagcttcaggatgatgtggtgttcaaggcatatatcggtctcaaacatatcgaacctttcattgaggatgccgttcgggagatgcataaagacgggattacagaagccgtcagcatcgtgctcgcgccccatttctccacctttagcgtacagtcgtacaacaagcgggcgaaagacgaggctgaaaagctcggcgaattgtcgatcacatcgatcaacagctggtatgatgagccgaaatttatcgcttattgggcggatcaggtgagaaaaatctatgacgaaatgccttcggaagagagggaaaacgccgtcttgattgtatcggcgcacagccttcccgaaaaaatcgtcgaaatgggtgatccgtatcctgaacagcttaaagaatcagcgaagctgattgccgaagcggcgggagtaaaagattacgccgtcggctggcaaagcgaaggaaacacccctgatccgtggctgggaccggatgttcaggatttgacgcgcgacttgtcagagcaaaaagggtacagcgcttttgtttatgctcccgtcggctttgtagccgaccatttggaagtcctttatgacaatgactatgagtgcaaagtcgtcacggacgatatcggagcaagctattacagacctgaaatgcctaacgctaaacatgagtttatcgatgctttagcggatgttgtattaaaacaattggagaaagaacagtaaagaaggcgattgtaaatgagtggagaacgcaggcagattgtcatcatcggcggcggtattaccgggttggccgccgccttctacttggagaaggaaatcaaaaagaatgatctcccggccgaagtcacgcttgttgaagcaagcccgagactgggcggaaagatgcagacggtacacaaagacggctatgtgattgaacggggtccggattcatttttggaacggaaacaaagcgcacctcagctcgtgaaggatctcggactggagcatttgcttgtgaacaatgcgactggccagtcttatgtgcttgtcagcgaaacgctctatccgattccggaaggagccgtgatgggggtgccgacaaaaatcggtccttttctgacaaccggcttgttttccttgccggggaagttgagagccggaatggatttggtgcttccagcaagcaagccgcaggaagaccaatcgctcggagaatttttcagaaggcgcgtcggcggtgaagtggtggagaacctgatcgaaccgcttttgtcaggcatttatgccggggacatcgaccgtctcagtctgatgtcgactttcccgcagttctatcagacagagcagaagtacagaagcttgatcatcgggatgaaaaaatcgcgcggcgcccagagcgccggaaagcctgcaaacaaaaagaaaggccagttccagacggtgaaaaccggcctgcagacgatagttgaagaattggaaaagcagctcggcatcacaaaggtttataaaggcacaaaggtcgtcagcattgagcgtgcgggctcggcttacagcatgaagcttgacaacggcaaggtgcttcacgccgattcggccgtggtcaccgctcctcataaagcagctgccgcgatgtttcaaaaagaggattggctgaagggtttagaggatatggtgtcaacatctgtcgccaatgtggcgctcggatttccggaagaagccgtccaaatggagcatcaaggcacgggctttgtcatttcaagaaacagcgatttttccattacggcgtgtacctggacaaacaaaaaatggccgagcacaacgcctgaaggaaaagtcctgctaagggcttatgtagggaaagccggcgatgagtccgttgtcgaacagtctgataacgaaatggtgaaaatcgtcctcgacgatttaaaacggattatgaagatcgacggcgaaccggaaatgacctgcatcacaagatggcatgaagcgatgccgcaataccatgtcggccataagaaaagaattaaagaaatcagggaaggcttggaagcgtcctatccgggtgttttcattacgggggcctcatttgaaggggtcggcatccctgattgcatcgaccaaggcaagcaggccgtcgccgatgtactctcgcaccttttcgaataaagaagagcaaaaaaagctgaccgaaaccattcggcggctttttttattttcactctttttacagctttcatcattttaaagtttgtttatggaaaagataacatttaatctttgcattttacatttatatgtgttacattactttttgtacttactgaccaaaatgttcaaatagtcaattccggggtgagaaaccgtgagcaaagatcgaaaagcactgattttagaagcggcgacaaaatcgtttacacaattcggctacaaagcgacgacgatggatctggtggcgaagcttgccaatgtcggcaagggtacgatctatacctttttcaagaataaagaggaactgttcgatgacattttttcttcgcttctgattgaaatgaagcaaacggctgatcaagcgattgaccctgatctgccttttcacgaaaatgcccatcgcgcgatgatggcgatattggagtacagaaagaggcaccagctgaccattaagatctttcaggaaggcgcggagctcggcacaccggcggcccgcgaggtgattgaaaagctggaacgcatggtcatcggctatattaagagaaaaattaaagaagcaattaaaaatgacgatattagaccgtgtgacccagagctgaacgcgtttgtcatcttcaagctttacatcgcgctcatctttgactgggaaaaaaaccatgaaccgctgaaagatgaagagttggcagagatgctgaaaatgtatattttaaaaggattatctcgttagattatcctttctttgtttaaaggggtgcttagtcgcgtaaggagagcggctactaactaggaggcgtatcaacatgaatgttttcaaaaaccagtggagagaactgataaccaataaaaaactactgatatccgtgatcggggttctctttataccgctgatttacagcagcatatttttggcggcttactgggacccatacggaaacgtcgatcagctccctgtggcggttgtgaattccgacaaggggacgacatatgaaggaaaagaccttcatatcggcgacgaccttgtcaaagaactgaaagaaaacgataaattcgactggcattttacgacgaaggaaaaagcaatgagaggcttgcaaaatgaggaatactacatggttgtagaaatccctgaaaacttttcgaaggatgccagcacggttatggataaacatccgaaaaagctgaatctgatttatcatacaaacgccggacgaaactatgtcggcgcccagatcagcgataaagcgattgaacagcttcagcattcagtcggctctgaaatcacggagcaatatgctgaagtcatctttgacaatttcggcaaaattgcaaaaggtctcggtgaagcaagcgaaggagccggaaagctggataaaggactgaaagatgcgaaagaaggaagcgaaaagctgaaaaagaaccttgaaaagctcgcgaaaagccaaattcagttcaacaaagacggaatggagaagttcggcgcggcattcaatacgctgaacgacaaaattcatgagcttgattccgggcttgcacaatttttggaaaaaagcggccagctgcacagcggtgctcaacagctccaacaaggcatgcctcagattgtggcgggattggagcagatgaatgaaaaagcgcagaagataagcaaactcgaagaagcgatttcaaatgaaaaaattcagcagctcgaaacggcgctttcaaatgccgaaaaagcgaaaaaagaaatcagccagatttcgaaaaatattgatgagcttgaagcggcattgaaaaaccagcacagcgaagtcaaacaaattattgaatccagcaacatgctgacacaagaacagaaagccgcgcttatgaaacaagtcgatgaaaaaatgggaacggtgaaactccctgagtttgacaagttgaaagcgcaaattcccgatgtcagcgaacttcccgatttatccgggctgaaacagaagcttgaggaattgaagcgagtcccttcggatgtgaataaactttataaaggatcgcagaagattcagcaagggcttgatgcgctgacaaacggtttgggtgcttacaacgaaaaattcgcagaagcgaaaagcggatcatccaaaatcgccgaaggcagccagacgttagtcggaaagttcggcgatctgcaaagcgcggccgataaactgaaagacggttcttccaaacttgcagaaggggctaaatcccttgatgaaggtcttggcaagctgtctgacggaagcggggagctgtttgataagctgtctgacgctgccgatcaaaccggcgatattcaagcgggagacgaaaactacaatatgttctcagaccccgttgatgtgaaaggcgataaaatcgatccggtttccaactacggaacaggattaaccccgtatatcttgtcgctcggcttattcgtcggcgcattgatgattaccgttgtcttcgatgtgaaagagccggctgtccggcccgaatcagcctttggctggtttatgagcaaattcagcgtgctttttgcagtgggaattcttcaagcggcgattgcatgcacgatcattctctggggcatcgggcttgaagtgcaaagcgtctggagattctatctgttcagtataatcatgagcattacatgtcttgcgatcattcagtttttggctgcgacaatgggaaatccgggacgattcattgccgtcattctgctcgtgcttcagcttggaggaagcggaggaacatttcctcttgcacttgtccctaagttcttccaggtcatccattctgcactgccgatgacctacagcattgccggatacagagcggtgatttcaagcggagactacgcgtatatgtgggaacaggctgccgtgctcggcggtgttgcgatcgtcatgatggctctgacgctgatttattttaaagtgctgctgaaaaaaggaaaaattgaagagcagcatgcataaaagaaaaacatcttttcaagcccggcaagggcaagaaaagatgttttttttgatattaggaagctggcgcgccccattttacaatcaggcccgtatatgtaagacccccgccaaaaccgaacagaatcaaggtgtcgccttttttcagctttccgtttttgacggcttcatcaagggcgagaacgattgatgcggatgaggtgttgccaaaccattcgacgcttgtcagcgctttttcggctggaatttcggttttttcgcaaatcgattcgatcattcgcagattcgcgctgtgcgggacgaaccaatcgatatctttcagctccatttcagcttgggcaagcagttttttgacgccttcaggaacggacctgaccgcccatttatacacttcgcggccgttttgaaccatttttccttcacctgagagcggctcccctttaaggtcgctgcgcaagccggttctgtataaatggcgggctccgtcacctttcgtatcctgggtaaaagtaataaagcttggggaattgtcgtcccgttcgacaagcagggcgcccgcgccgtcgccgaacaaaatgcaagacgcgcggtctgtgtagtcggttgttttggataaggtttcaccgctgatcacaagaatttttttatgcagtccggaagtgatcaggccgttggcgatatgcaatccgtatgttaatcccgcgcaagtcgcatttacatccaccgcgccgacttctttccatccgaagtgctcctgaacctggcatgccgtgcttggaaaagcatagtccgccgttgtggtagagacgatgatcatgtcaatatcgtcaagcgtgccgctgtatctgttttttagatcttcaaccgcctttatgcaaagatctgatgtgaattcgtgactcccggcgattcgcctttctttcattcctgtccgctgaatgatccattcatcagaagtatcaacgatcttttcaaactctttgtttgtcatgcgcttttcgggaacataggtgccgatggcggaaattcgcgcttttgataaagttttcatgaaattcactctcctttttcttattatatcacctagtattagtatctggtactaaaatgttgatatgaggtatactataaccattacaagttgggaggaatgaaccatgtcaggacagaaaacgatggagctcatcaaggagctcgtctccatcccgagccctaccggaaatacgtatgacattatagactatatcaaccgccttttagagaaagaaggagttgaaacaaggcataaccgtaaaggcggcctgatcgcgacgataccgggctctgacaaatcccggcacaggatgctgaccgctcatgtcgataccctcggagctatggtgaaagagattaaaccgaacggaaggctgaaaattgatttaatcgggggcttcaattacaactcgattgaaggcgagtattgcaacattgaaacagcatctgggaaaacttacaccggcaccatcttaatgcatcagacatcagtgcatgtatacaaagacgccggaaaagccgagcggaaccagaaaaatatggaggtccgcattgacgaaccggtcaatagtgaagaagaaacccgggcgctcggcatcaatgtcggcgattttatctccttcgatccgcgcgttgaaatcacgccgagcgggtttatcaaatcgcgtcatctcgacgataaagcaagcgtcgccctcctcatcgagctgatcagaaccatcaacacagaagggatgacactgccttatacgacgcactttttaatttccaacaatgaagaaatcggttatggcggcaactccaacatcccgcctgaaacggtggaatatttggctgttgatatgggagcgatcggcgatggacagtcaacagatgaatatacggtatccatttgtgtaaaggatgccagcggcccatatcactacgggcttcgaaagcgcctgacagccctttgtgaagcacatggaatcgattataagcttgatatttacccatactacggttcagatgcttcagcggccgtcaaagcgggccatgatatcgtccacgggctgatcggcccgggaattgacgcatcccatgcgtttgaaaggacgcatcaatcgtccttggagcagacggcaaagctgctgtatcactatgttcagtctgacatggcataaaaaagctcccaaaggaccccggtcccttgggagtaaaaaaagagtggaagtcatccatccgtaaaggatggcgtttacttaccagtaatcatagtgttttttctttttgcagtgatcaaagtggtcaaacttcttgtagtcatagtcataatcatacttcttaaagcatggataatagtagtaataatagtagtagtagtatttcttgcagtcatggtctttcttgtggtaatcatagtcataatctttcttgcaatggtcatggtaaaaatacattaaacttccctccaattttcttttctaatttaactacagtacatcgtatgtaaacaaaaggaagttgtttggacaggttgcttgagaaattcgtatatttttttaaaaaaacgtatgtcttcccgggatggaaaacatacgttttttgatagaaaagggggtcagccggatacttctatatctgccggctcccgttgatttaagacgttctgccctttaacggcgtcatattcaccttcccattttgacatgaccacagcggcgagagcgtttccggtcaagttgacgaccgttctcgccatgtccataatccggtcgactccggcaatgaaggccagcccttcagcaggaacgccgatcgtgcccaaagtcgcaagaagaacgacgaaagatgtgccgggaacggcagccatacctttagaagtgaccatcagaacaaggattaacgtgagctgctgtccaatggatagatcgatgccgtagacctgcgccagaaacagcgccgcgatcgcttgatacaggacagagccgtcaaggttaaatgtatagccgatcggaatgacaaacgacacgatgcctttcggacagccgattttctccatcttttccatgacgcgcggaagcacggtttcagagcttgatgtactgtacgcaagaagaagctcatctttcaaaaaagccaaaaatttaaatatattgataccgcaaagcttgccgacgatcccaaagataacgatcaagaagaaagcaagagccaggtagacaagtaaaacgagctttcccaatgataaaagcgaagaaaaaccaaattttgaaaccgtcacgccaattaaagcaaaaacgccgaacggcgcgaatttcataacgatgttgacgacgtggaacatggcttgagacgttgcctcgaaaaaggagagcacaggcttgcctttttcgcctatggcagacaccccgagtgcgaacagaacagtgaagcaaatgatcgcaagcagatcgccttcagcgagcgactggaaaaagtttgtcggcacaatgtgcaggaacgtgtctgcgacagatttggtgcttgcttctttttctgtttctacatattggctgatatcctgtttttcagcaccagaaaagtttacgccgtgcccaggctgaatgatgtttccgaggagaagtccgagcacaatcgcaaaagtcgtaatgatttcaaagtaaaggatcgtccgaaagccgagcctgccgacctttttgccgctgccggcccccgcaaccccgacaatcaagcttgaaacgacaataggaatcacaatcattttgattaatcttaagaacaaatcgccgacgggctgcagatacgttgcaaccgcaggatttccgaaccaaatcgctcctgctgcaacacctaaaatcagcccgaggaaaatttgtgtggctaatccgaatttaagtcttttcatagatgccctcccaacgcatacttaattttatactagaatattaaactgagatcgtaaattaagtatagcgaaagaaaaagcagctcgtccataaaaaaaataacgtctgaatatattgaaaattcgaatatgagatgattatcccagcttaaattcaaatcgggacaatcatcggtgtatattttcctaagtgaaatagtaaaatgttattaaaataatgaattttgacaagaatctctctctttataactaactttatgacaaaaaaaagccccggggaatccgccggggcctttctagtgaagtctatatatcttttacttttaagcatttagagcaggtgtttccgtagcattcgtgctgctcatcaatatcgtggccgcacactgaacattttttggaaggcaaatttctgaagaactcggtgattttagcgagcatgttgattcccccaattcgtttgttgcaatcattgtattataacagagaccggaaaatcaatgtctgttttatgacaaaatataaaacatgcaatttttaagaaaaatgggtatattgaatagggggacgatagacacgaaaaagaggtgtgtatacatgaaggtgacagtcatcggctgctgcggaggatttccggctgcaaatgaagcgacttcaggctatctctttcaatccggggactattccgttttaatcgactgcggcagtgccgttttatccaaacttcagctgtttctgcccgttgaggagctagatgccgttatattatcccattatcatcatgaccatattgcggatgtcggccctttgcaatttgccaaactggtcggctcattcctcggcaagggagcggatgcccttccgatatatggacatccttttgatgaagagcagttttcaaagcttacatataaaacgcataccgctggattggcgtatgatccgacacagcctttggctatcggaccgtttacgttcacgtttttaaaaacggttcaccctgttgactgctttgccatgagggtgacggacggtgttcattctgtcgtttatacggccgactcgagctttcaggaagcctttattccgttcagcgaaggagccgatctcttgatctcagagtgcaacttttatgcggatcaggatgggaggagcgccggtcatatgaacagtcttgaagcggggcggatcgctgcggaagcgggtgccgggcagcttctcttgacacacctcccgcatttcggggaacaccaaaaactgatagaagaggcccaaaccgtttataaaggtgcggttgttctggcgcacaccggttatgtgtggggagaatagaaggaggaactgacaaacatgctgtttatcgataatcaaaatattacagatccgaggatcaacttggcgattgaggagtactgcttaaagcatctcgatcctgaagagacgtatctgctgttttatatcaaccagccgtcgatcatcatcggcaaaaatcaaaatacgatcgaggaaatcaacacaaaatatgtagatgaaaacgggatcattgtcgtccgcaggctgtcaggcggcggagctgtctaccatgatctcgggaacttgaacttcagttttattacgaaggacgacggcaacagcttccacaacttcaagaagtttactgagcccgttgtggccgctttaaaacggcttggcgtcgatgcggagctgagcggccgaaacgatttgatggcaaacggccggaaaatctcgggaaacgcccagttttcaacgaaaggaagaatgttcagccacggcacgctgttgttcgattctgagattgaacatgtcgtatcggctttaaaagtgaaaaaagataaaatcgaatcaaaaggcattaaatcgatcaggagccgtgtggccaatattagcgagtttctcgatcagaagatgacgacagtggaattccgaagcatgcttctccgctatatttttgataccgaaggggaaataccggagtataagctgactgaaaaagactggaaaatcattaatcaaatttcaaaggaacgctatcaaaactgggattggaactatgggaagtctccgaaattcaatctgcagcattctaaacgatttcaagctggatcggtcgacatccgcctcgaagtgcaaaaaggcgtgatccgcgagtgcaaaatattcggtgactttttcggagtcggagatgtcagcgacatcgaagagaagctgacaggcgtgcagtatgaaagaaaagcgattgaagaagctcttcaaggcgtggacattaagcattacttcggcaatattcaaaaagaagaatttttggatcttgtctactaatagagaggctgcggtttccgcggccccttttttaacatgagaggaatggaagatatttcccggcagcccttgagtgttttctgttcatttactataatgggaatagattttgattatcacaaaatgaatggtcattcattcattttttaaaggggtgggagaatgaatttagtttcaaaattaggggaaacagctcaatcaaagcctgacagaaccgcttatatttttggagagcaaacggaaacatacgggggattgcagcagaaaattgattgctttgccgaagggctgcgcgaaatcggggtggaaaagggagatcatgtcgctttgctactcggcaatacaccgcattttgtgattgcgttttacggcgcgctgaaggccggggctgtcgtcataccgatcaatccggcctatacgccgactgagatcggctatatgctgacaaatggcgatgcaaaagtgatcgtggctctgggacagctgcttccgctttacgaaaaggtgcatgaatcccttccgaaagtcggctgcgtcgtgctttgcgaaactggagagccgcttcaggaaccggaaaacacagaggttaagatgaaattgaaatcgtttacaagcattatgaaacctcctgtccggccgtttcctgaaatcgatgacgaagatacggccgccatcctctatacgtcaggcaccacgggaagaccaaaaggggcgatgctcacacatcaaaatctattttcgaatgcaaatgatacagcccgctatctgacaatgaatgaatctgaccttgtcgtcgccgccctgccgatgttccacgttttttgtttaacggtctgcatgaatgcaccgctcatgaacggcgcagcgattttgatcgtgccgaaattcagtcccgccgaggttttcaagctgattaaaaagcatcaggcgacgatcttctcaggcgttccgacaatgtacaattacctgtaccagtatgaaggagcggatgaaacaggctttcggtccatcaggctttgcatctcaggcggagcggccatgcctgtcgctctcctgaaaagctttgaagaaaggttcggcgtcctcgttttagaaggctacggcttgtcggaggcttctcctgttacatgctttaacccgttcagcaccggccgcaagccaggatcgatcggcacgaacattctcaatgtgaaaaacaaagtcgtcaatgaactcggggaagagctgcctgccggccaagtcggcgagctgatcgttaaagggcctaatgtcatgaaagggtactacaaaatgccggatgagacggcccatacgataaaagacggatggctgtatacaggtgatttggcaaaacgggatgaagacggttatttttatatcgtcgacagaaaaaaagatatgattatcgtcggcggctataatgtctatccgagggaaatcgaagaggtgctctacctccatccaaaaatcgcagaagcggtggtgatcggagtgcccgatccgaatacgggagaagccgttcattgctatgtcgttccgaaggataaaacgctgacagaggaggatgtcttgtcgcactgcaaaaagcatcttgccaaatacaagcgcccgtcggcgatcgttttcatggatgaaattccgaaaaactcgaccggcaaaattttaaggcgcgctttaaaagacattctgacaaacaaatcttgacccgctaaaagggacgcctgccgcgtcccttttttgcaattctcctaggagggcgtctttttccctttgttggagaacgaaatatgtgccttcctcttctttcaggatgacggcttcatctttcttcagccagacggtgaagtgaacgcgatgtgtgccggtcatgctgatgtatccgtgatacgccggagaaggcaggtgatgcgctgtctttttcttcattcttttccctttattaaatgtatcaagcaggacggctatgttgtgcctgtctttgatgctgaccgttttttcactgtctcccgcctgcttcaagatgatttcttctgcatttcttgagtcgaaaggctccgccatcaagtggaatacataaaagacagtgatggataaaatgccgaaaaaaagtgcgatccccattatttttttcagaatgatcaccccaggctatctattttctccctttaaagccttttcatcctgagaaattatgctataatgttcaataaattatacgaatgtttaatttattataagggggcggaagatgaattcgattgaaaaacaagtggcagaaaacattaagaggctgcgaaaaatccgcaattacagccttgatcaattgtcatcgatgaccggcgtcagcaaaggcatgctcgcgcaaattgaaaaaggctcttcaagtccgacaatcacaaccttgtggaagatcgcaaacgggctgcaagtatcatttacttctttggcagaaaggcctgccggggagccgacggtcgtcagaaagcacgagaaaacgcctgttatggccggagaagaaaaatacgcggcatttccgcattttccgttcgaccagaaaaagaagtttgaaatcttttatattgaacttgcgcccggctgtgtgcacgaatcagagcctcaccacggagggattgaagagtacgtgctcgtctctaaaggcgcgcttgcggtgacggcgggtgattacacctgcgacttgaacgagggtgatgcaatgcatttcaccgcaaacaccgttcatacgtacaaaaacaacacggaacaaacggcatcatgctatacactcatttattatccgtaaagaggtgtcaagatggaaaagcaggattcactcaactttctagacgggcttcgttcaggggtttcccttgccgtcggctacatcccggtcgccttgacattcgggcttttggcaaaaacaacggggctgtcgctttttgaaacgtttttgatgagcgcccttgttttcggaggagcgtcccagtatatgtctctgagcatgcttgccgttcagacaggaatcatcgaaatcgtcatgacgacgttcattgtgaacatcagacattttttattttcagcgactttgaatcaattggtagaaaaagattcgccttggaaaaaagcgttttactcatttttcgcggtgacagatgaatcgtttgccgtcgctgctttaagaaaggaaaagctgacgaccgggtacatgatcggcctcggctcgatcggctatgtaagctgggttttttggagtgcggccgggcattttgcaggggccgccatgccggccgttctccaggaaagcatgagcatcgccctttatgccatgtttatcggattgttggtgccgcctttgaaaaaacagcgaaaagtcctgctgctggcgggggcggctgcgctattcaataccgttttccaaatgaacggaatattgtcggcaggatggtcgatcgtctgcgctacgcttttatccgccatcctgatcgaatggctgtaccaatttagaacagaggggaagagaaactatgtttagcccgatcatctggatgattatcggcatggctgccgttacatatgtgccgcggatggtgccgctcattgcttttgaaagcctgaagcttcccggatttttggagcgcgtgctgaaaaatgtgccgtacgccgttttaggagctctcatttttcctggaattttttcggtgcaaagcggtatgctctatggacttgccggcgctcttatcgcatttttattttcctattttggagcaagcgtcatagtcgtcgtgatggggacgattttgacgctcgcaggggccggcctcttgctctcattgtaaggcttggttctaactttcacaggaaaagcttacaatagaagtaactgctatgtgagaggaagtgattcgccatgcggaaatggatcgcgggagccgttctcctgtatgtgctgtacggcctttttttctattggtatctctttatggccggtgaaccctccgttcccgaggcgctgaaagggacaagcgcagacccggcgacatttatgaacgaaagggaactcatgctgacggaagagtactcgaaaataaaggactttctgttttttatccggattccgtttgagtggttcttatttttaatattgttgattgccggtttatcgaagaaaatgaagaattgggcggagcagacgtcaaagcggagaacgattcaaataacggcatatgtttttgctttgtttctgatcgtcacgatcgtttctttgccgcttgactggatcagctatcaatattcgcttgactacggcatatcaacacagacaaccgcgagctggatcaaagaccaggtgatcgacttctggatcagctttccgataacggctgcggcggtgatcgtcttttactttttgatcaaaaagcatgaaaaacgctggtggttttatgcctggtgcctgacggttccggttacgctgtttttatttttccttcagccggttgtcatcgatcctttatacaatgacttttatccgctgaaaaataaagatctcgaacaaagcattctgaagctggccgatcaggcagatattcctgcgaatcacgtctatgaagtgaacatgtctgaaaaaacgaatgcgttaaatgcttatgtgacagggatcggcgccaataaaaggattgtgctctgggataccacgctgaacaagctggatgagccggaaattttattcattatggcgcacgaaatggggcactatgtgatgaagcatgtttacataggactcggcgggtacctgcttttatcccttgccgtcttttatgtgatcgacaagctgtacaagcggatcatcggccgctatggaaaaagcctccgcattgcgggaaaatccgatcttgccgcactcccgcttctcctgatgctgatgggggtcatctctttcgcgtcttctccatttacaaacgcagtttcgaggcatcaggaaaaagccgctgaccagtatgcgattgaactgacgaacaacagcgatgcagcggttgcgacttttcaagagctctcaaaagccgggttgagcgaggcgaacccgccgtttctcgtcaagatttttaaatacggccatccgaccataatggaacggattcaaaatattgaacagtcttcaactgaatgaagaaaaagctagtgctaaaaacactagctttttctatatgccatttgttagaatatgttattgagcggcagcttcgacattgatcagaccttttccatagtagaaggagcttcccaaataagtcgccgtactggagagacggttgcggacttgtgaagctgaaaggttcggatgttttgacaagatcaaagctgctgctcccgctacatgaggagaagccattgacgttccgttcaatgttgcataagtgctggttgggtaagtgctgtacacgcctgcgccaggagccatgacttcaagctctgctccgacgctggaaaatgaagctctgttgctgttagagtctaccgcgccaactgcgatgacagagtcgtatttcgcaggatagccgattgtattcgtgtttcctgaagatccgctgttcccagcagccgccacaacgacaacccctcttgcatatgcattgtcaaccgcctgtttcatcgctgttgagcctgatggtcctccaaggctcatgttgataacatccatgccgtttgtcgtcgcccactcgattccgcttacaatgccgctgtaagatccgcttccgcttgaattcagcactttaaccgcgtacaaggatacgttcggcgcaacgcctaatacacccgttgtattgtcaagcgcagctactgtaccggcaacatgcgtgccgtgtccgttgccgtcggtgttataagcttcgccagctacgaagcttgctccgccgactacgttcaagtccggatgagaagcttggattcctgtatccaggacggcgacttttacgttcgctcccttgtagccttgagcctgcactttgtccgctttaatgagaggaatgccgtaaggaacggtttgcgccaaagcatgagctacgtgatcctcttccacataagcgacatccggatcatttttgacttcctcaagcgcttctttgtctagcttcgcttttgccgcgttgatgattctaaactgcttgtccacttttccgccgctctctttgatgatgtcctttttgacggatgcggttttcactcccgacttaaatccgacaatataatccttttcaacatttttcgccggctgagcagcagacgcggaatcgctgaaggccatcgtgaacacgagcattaaggccgtcagcatcccaagccaaaaactctttttcctcatcattactcactctcctccgttttattcagaataattgaaatagaagaataatatattctattctaattattctgttaatttattatagaaaaaaaatgaattatatggtagacccatttttttgaacggccaatttaaatttattggttattaataactgttttagaaaaatattcggttcgaaagtatgaatagaccgcttcaacctggcagggaaagaggtcccggggtccgtgaatgacaggagattgcttcgtctgattcattttatgaaaatactattcatttattttatgagatcattttttgccgaaggaggttgcggccttgtcgatcatctattaaaatatgcaatatatcgcatacagaaacgggtgaaagatatgaaatcagctcatgtgaaaggcgtattgatggtgcttgcaggggcttcattgtggggattatcgggaagcgctgcacagtacatatttgaaaggggagcggttgaagccggctcgcttgtctctgtcaggcttctggcatcgggcgtcattctcttgctatatgtttcaatgaaaaacggttttcaacatgtgtgtcagatatggaagaaaaaaacagatatttgttcgattttagtattttccatttttggaatgcttgctgttcaatatacgttttttgcttcaatcgaaaagggaaatgccgcggctgctgcaattcttcaatacttggcgccttttttcgtattgttttacctatatgttaaaaaagaacttccgcctaagtggaaagatgccgtacttactttattggcgcttttcggcgtgtttcttcttttgacaggcggaaggccggacagtttgtatattccggccgaggccgccgtttggggcattttgtccggtggagcgcttgctttctatacggtttttgcaggaggattaattcaatcgttcggtgctttgacggttacgggatggggtatgctcgtcggaggggccggaatttcttttttgtttccgccgtttcggtttgacctttcgcacattggggcaggggaggcggcagccattctgtttgttgtattgtgcggcacagctttggcgtttgccctatacatcggcagcctttcttatctttccgcaaaagaaacgagctgcctgagctgcgccgaaccgcttgcggccgttctgtcgtcggcgctctggctgggtgtgcccttcaatgcctttcaaggagccggtacggtgatggtgatcattacggtcatcatcctttccctcagcagagaaagaaaagcagcagattctgtcaatgaaagggtgtagaaaggagagggaggctcctttcttttttaaaatgataatgattatcattgtcattgatggagggagttgctataataagctcgtctactacaaaaaaggagatatatatgaagcacaaatattttgctattttatttttattgatgatatcagtgatgacggcctgctctggaggaagcgagagcacgaaaacttccggtcaggattccgtgacagttaagcatgatcttggagaaacgaaagtgcggaataaaccgaaaaaagttgtggttcttgaattgggatttattgatgcgctccttgatgcgggtattaagcctgtcggaattgcggacgacggcaaacctaagtttattaacgagaaggtcaggggaaaaatcaaagggtatacttcagtcggttcgcgcgcccagccaagctttgaaaaaattgcttctttaaagcccgatttaattattgccgattcgagcaggcacagcggcgtctatgataagctgtcgaaaattgcgccgacaatcgcgctcaaaaacttgaatgccgattatcaggacacgcttgatgcatctcttacgattgcgaaagccgtcggcaaagaaagcgcaatggagaaaaaattggctgaacataaacaaaagctggatgaattgaaacagaaattcggcagccggaaacagagcattcttctgctcgggaacacaaatgaagaaatcaccgtgcgcgatgaaaactttttcacgtctcagcttctgacgaaaatcggctatacatacggtgtcggagacagcggcaaaggcgatgccgaaaacggtgaatccgtcaatattaaaatgacgctcgaacagctgcttgagaaagatcccgacgttattgtcctgatgacgggagaaaaagataaagtcgatgaagacgggaaaagaccgatcgaaaaagatcctctttggaaaaagctcagcgcagtcaaaaacggcaaggtttatgaagccgacagattcgcctggtcgctccgacgcagcattgacggagcagatgagctgatggatgaaatcgatcagcatcttctgtctgaggatcaaaagaaatcttaggagcctgccggcttgttggacgggatgacgcatgcttttgtaaaaaagcatgcgcttgttttttctaaaggagtgacctgttttgatatatatgaaacgttttgcaccgctcatttttgtttttcttttgcttgcgagttttgcgctttctgtttcaatcggttcgtcaatgattgcactgtccgatatttgggcggctgtttttgcgtacgacggttcaaaattgcacgcgattattcagtccatccgaattccgcgcgcattgaccgccgcattaatcggcgcgaatctaggggctgcgggcgcgctgatgcaggcggtgacaagaaatgcgctcgcatctccgagcatcttcggaatcaatgcaggggcctcgcttgctgtcgtatgtttgacggtgatgtttcctgcgcttgcagctccccagacagcgatgggagccgcatttgccggcggtgcagcggccgcgctgatcgtgtacgcggttgcctcagtattcagcgaacatgacagggatatcagctttgccttgattggcgttgtcattcaggcgattcttgcttcgatgacgcaaatgctgcttatctttcatgaagagtcgacggaaacgctattgttttggctttccggttctttagcggggagctcatgggataagcttcatttattggttccggtgagcattgcgggtttgttgacggctttggccttagggagggcggcttccgtcatgagtctcggagatgaagtttctcatgggctgggacaaaaagtatggctcagcagattgctaatcgccttcactgttgtcgcattggcgggagtgtccgtttccgccgccggtccgattggtttcatcggtttgatggttcctcatatgatccggtatctcatcggtgctgactaccgggcggtgattccgtattcggcattgcttggagccgttcttttgctgtttgccgatattttgtcccgctttgtctattttccgtaccaaacgcctgtcggagttgtcacggcaatgattgggacgccgttttttatctatttggcgagaagacggaaaaagggggcggcataatgaacaatccggcaagaaagacgaaaaggcggcgcggacaatcggcggttgttctctgtgcgctattcgcctgtttgtttgtgctcattgtactcaatttggcgatcggcgatgaaaacatcggactgtgggacgtattgaaatcgctggcaggacaaggcgatgcgggagtccgctttttggtgatggaatttcgaatgccgcgaatcctcctcgctgtgcttgccggaggggcgctttcgatcgcgggtgtagtcgctcaatttctgatgaaaaatccgctggccgcccctgacacgcttgggattacaggaggagcgggattgggcgctgtgatcgttacggtcttgttttcacagcaaagtccgcttctgctgacaggcgccgccttttcaggaagcgttttagctgcgatcctcgtctatttattggcttatcgaaatgggatctctcctgtgcggctggctcttgtcgggatagcggtcaatgctttctgccattcgggcattcagctgttaatctcaagggggagcccgaatgtcaacagcgcattaatttggctgaacggaagtctgtggggaagaggctggcaggatgtattgcctcttttcatatggtgctgtctggtgattcctccgatatggcttgcggcaaaaccgctcgatatcatcaaatcaggggacgggattgccgtcggcctcggcatccggcttgaaagaacaaggtttctgctgcttgccggtgcggttttgctgacagctgctgctgtgaccgctgtgggaacgatcggttttatcgggctgatggcgcctcatatcgcaagaaagctcgcaggggctgaaacgaagatcttgattcccgttgcagctctcgtcggcggcatcgtccttttgatagccgatgccgccggaagaggtcttgttccgccgcttgaaataccggccggattgatcgcagccgttatcggcgggccgtattttatctatttgctgcgccgcgaagaacataaaaaaagacggcatgcttgatgccgtctttttttaatctgacaaatggtgtgaaaggttgtaatccttcacatgccatttattttcatgaaatttgatgttgcttaggcaggcattgacgagcttcgtgttttccaggttgatgtcgccgtttgagatttttgacagaagcgcgtgtatcgcggctccgtgtgcgacgatcagcacttttttgtccggataccgctcactgaccttttgaacgccggccatcagccgttcggcaagcgcttcttttgattcctgattcggatattctttatcaggatagagcctcattctttcttcgaatggcattccttctgcatctccgtaattcctctcgatgaaatcctccatttcgatgatttcaagtccgaggtattgattgatgatttcagcggtttctttcgctcttcttaaagggcttgtaatgatgacgtcccagtcggaccctttcaaaaacgccccggtttcttttgcttgttttttaccggtttcatttaaagggatatctgttcttccctgcagttttcctaaagcattccagtccgtctcgccgtgccggatcaaacaaatcgcagtcatgctaaaagtctcctttcgaacttggggtgcgcattttcggtgatatggccattatactaaatttaaaaaacggaaccacgaaatatgactggcaccgaacaacatttacatgattttttcaaacaggctgtgccgattctgctgttttttcgatcacgtctgcaatcgttgtcgagcgttgccgtgatggctgtgaatatatatctttgcttgcacggcagacttctcaaagtatggatgtgaaaaaatacacaggtcatgattgacctgtgtacggtaacgcctcatttttttgtcagctctacgagagaatcgactgaaactgcgacttgtgatacggcggcattgacatcttgaaggccgcttaaaaacgactgcaggtcgccttcgattcggccgctttgctctttgctcgttttcatattggagacgatatcatcgaataggcgattgatctccgacatcttgtctttgctttcgttcacaagctgatttacatctgtaatatgcttcgtgacgatcgagatttgagcgtttgtgttattgacgagctctgatacggtggagacggtttttttcgtatcatcggacagctttctgacttcgtttgcgacaactgcgaaacctttgccgtgctctcctgcccttgccgattcgatcgaggcgttgagcgaaagcaaattcgtctgttcggcaatgcctgttacgatgccgaatatcttttcgatctgcagcgcgatttcttccagctttttaatttcctgctcgatttgcgtcatgctgcttcccatttgattcagctgctgttcctgttcctcaagctccttttttccgccgatcgatttttgttcgacagaaacggctgtcttcgttccggctcttgacgtttcggcgatctcggaagatttgtcgaccaattcctgtacggcgcccgtcgtttcggcaaatatagcggccaaagaaccggaagtatctttaatttgcctgtgaagttcatttttgctttcttcatcaagtctgcggagcctcgcgtgttcgtcttcaaaggcctccaggacgatctgctgttcgatgttgagaattttggtgacggctttgacagaccgcctgtattcctcatcggataaggcgttttcaaagatcttcagcattgaaagaaggagatcttgaaatgcccccagataccactttggcaacagtccgatgcgaagatgaacgtgggcgatccggattcttttttctaaaaaggcttcgtcgatgacgcctgaaaacatttcctggatgtggatcgtcaatgtctttttgagacggtcgaccgagctgttgtcatggatgatctccatgagagagctttcatgctcaagattttgataaaatcgggtgacgatggtttcaatatgttcagtgactaagggcttcagcctgctcagcacccaaagatcctcatccgtcaaatcgaccattgccagctgttttttaaattctgcgtgctgattgagcctgattctttttgtttggtcagggctttccccagcaaaaaatgatcgttctgtctttctatcctttttgaataacacgatcgtatccccctgtaatcattaatgataaaactgccgtttttttgaaatttccagcatttatctttttatcggcaatttttcattactttttaacttgtacatctcagctttctggatctttaagaggttctacggcagggccctcaatgacatcgccgtcgatcgaaaaccttgagccgtggcacggacagtcccatgtcttttctccatcattccactcgacttcacagcccatatgggtgcatgttgtgtcaaccagatgaagctcgcctttttcatcgcgataagcgcccgcccgtttcccggcatgcgacacgaccgcgccttctccgttgacaaggtcttccggcttcctgatcggctgctcgagttttccttcggcaaagtgttttgcaacatccgcgttgtaggaaatcgcttttttgatgcttggatccgggtggaaacgggccggctgaaagacggcttgataaggattgtcttcacccgcgatatgatctgtcatcagctgcgcggcgagggtgctcgttgtcatgccccatttccgatatccggtggcgacgagaatgcgcttttctttcggatagatcggcccgatatacggaattttgtcaagcgtgattaaatcttgcgctgaccagcggtaagggatcgattcgatgccgagcacgccttccgcaaatgattcaagcgcctgataatgcttgattgtatcttctccctggccggttttgtggctttcaccgccgacaagaaccattttttctccgtcgatcgtcaccgagcgaagcgagcgtgaaggctggtctatacttaagtacatgccgcctggatacggcgttttcggcttgacggcgagcacgtatgaccggctcggctcaagccttgcaaaatagaatccttttttatcatgaaatggaaagtgcgtgcagcacgtgacataatcgctgaagatttgatgtccgcttcttgtcagcacttttggccggtcgccttctttgatttccttagacgccgtgttttcgtatatttttccgccggcttcccggacggcctctgcaaggtatttcaaatagtgcagcggatgaaactgggcctggtttttcatgacgagtcctgcttttacatcaattgggacggggagatctttgatgaattccctgtcaatcccgagcttttggtatgcttcatattcctttctgagtttttggaccgattgttcttcagttgtgtaaatgcacgcgtcctgttcttcaaaatcgcacggtatcttttgctcaagcacgaggtttttgataaaggacagcgccttgagatttgcttcataatacagcctcgcattcggcattccgatatgcccgatcagttcgtcatagatcagatcgtgctgcgcggtgattttggctgtcgtatagccggttgttccgtcgagtatccggccggattcgatcaagacgacgctgtagccttttttcgtcagcaaataagccgtcgtcagtccggtcatgccgccgccgatgatggcgacatctgttttgacatcttcagacagttcctcgaacgaaggaaggtctgtactgtttctccaatacgattcaggcgagtccggcagtttttgttcttgattgctcacaaagttccctccatcatgcatccgttttgttcttaaattttcccaattgagaaatattcatgcatgtgaagcggcttgtcataaaaaaggggcgttttcataaaatagtaaggttgaatcgatgtgaaggaggaatggttttgagcaagcagccgaagaaagtactgcctccccagcaccaaacacagcgtcccggattggagtatttgatggatccccggcccgttttcgaccggccgaaacgagagcgaaaactggctgggaaaaccgcgattattacgggaggagacagcggaatcggccgtgccgtgtccgttttgtttgcgaaggaaggcgcgaacgttgtcatcgtttacttaaatgaacaccgcgatgcagaagaaacaaaggggtatgtggaaaaagaaggcgtcggatgcaagctgattgcaggggacatcggggacgaggctttttgcaacgatgtggtgcgccgggcaaaggaagcattcccaacgatcgatattctcgtcaataatgcggctgaacagcatccgcaaaagggaatcgaaaaaatcacgagccatcagctgatccgaacgtttcagacgaatattttttccatgttttatttgacaaaagctgtgttgccgcatttgaaaaaaggcagctcaatcatcaatacgacctcgattacggcttatgccggcaatgaaaggctgatcgattattcttcgacgaaaggagcgattacatcatttacgcgttcgctcgctttgtcgcttgtcgatcagggcattcgtgtgaacggtgtggcaccggggccgatttggacgccgcttataccgtcgacgtttactgagagagaggtcgaaatattcggttcaacaacgccgatggaacggccgggacagcctgctgaagtggcgccgagctatctgtttctagccagcgacgattcttcctacatgacgggccaggtgctccatgtcaacggcggaacgattattaacggataaaaggccggactatttaaaaagccggcttttttcgcataagaaagccaatcccttgggattggccgttatgcgtgctttttcagcgctgtatattctcttgaaagctcaaggaaagattgcttatctcctttgtctaatgcttcattaatcttcttgctcagcgtgtgcaaacgccgtttaaaaagcgattcatcaaggaccatttgaatgtagatatccgtgatggttacatcaagttctttcaccttttgggtattgcgggacttcatgagctcagcgtacgattttttctctttcataaagattccccctgatgccttttttatagtatatggattacacaataaaaaatcaataagtatttataatttttagaaaattattcggagatgcgtgtttatgagaataaaagtttgtatatttggacaaagaaacacggatttaatcgaacaaaacataaaaatggcattttaaaaacatattttcaaattaattggaaaaaatcctgtcgttttgtaaaggataatgttagattaatagtataaatttactaacgattaggaggatcaaaatgagcacagaggatatgacaaaggatacgtatgaagtaaacagttcgacaatggctgtcctgcctctgggagagggggagaaacccgcctcaaaaatacttgagaccgacaggactttccgcgtcaatatgaagccgtttcaaattatcgaaagaagctgccgctatttcggatcgagctatgcgggaagaaaagcgggcacatatgaagtcattaaagtttcccataaaccgccgatcatggtggatcactcaaacaacatttttcttttccccacattttcctcaactcgtcctcagtgcgggtggctttcccatgcgcatgttcacgagttttgcgcggcaaagtatgacaacacgtttgtcacgtttgtcaacggggaaacgctggagctgcccgtatccatctcatctttcgaaaaccaggtttaccgaacggcatggctgagaacaaaatttatcgacaggattgaaggaaaccccatgcagaagaaacaggaatttatgctctatccgaaagaagaccggaatcagctgatatacgaattcatcctcagggagctgaaaaagcgctattgatctggagcggctttgaataaatagtgctcaagaagcgcggatacctggttgcggatgcggggattaaagtagttatgctcttcttcgtaaccctcatatataaaggaatacatcgtaaaggcttcgtcccgcgacacttcatgcaccttgattttccggcggcgcagttcattttttacgtcgtacaggtcgcgctgggcaagctttaacgcctgttcgatcagatgcagataggggtctttcagcttaaacggcccctgctggatgattttcatgtcccggtttaatatgctgacggtcatcgggaggtaaatcgccttttcaatcatatccctggcttcggcgggaattcttgtcatggcttttctcctcatttctttttttgttcaggaacatttgttctgtttttattttacacgaaatacggccttttaatcaagaacgggaaaaaatgactaaaatgatcaggttgtttcagactaatacagaaaacaaccgagacggatgatttaaagtttttgatttaaagtgtagaatagaagtagacaaccgccctgaggagaatcaatgttggagcaattattcagctattttacagaagagaatttaacagagttttttcagagctacagggcttttggtccttttgtagccgtactgctgccgtttattgaagcgctgctcccgtttttgcccctgctcgtgtttgttgttgccaatgtaaattcgttcggtttatggcaggggtttttgttgacgtgggtcggggcatctttaggttctatagcggtttttctttttatccgccatttcggccagcaaaaagcactcggttttatccgcaggcatccatccgtaaaaaaactgatgatctgggtggaaaaacggggcttcggtccgctgtttctcctgctttgctttccattcacgccttcggcggcggtaaatgttgtggcaggactttcgcgagtcagcctgctgcctttttcattggcggtgctttgcggcaagttcgtgatgatttttatggtgagctttgtcggccatgatctgaaggcgctttttacccagcctttgcggacagccgccgtgatcatcgtcatgctgatcttatggtacgccggaaaacgggttgaacatcgtctgaacgtgagattcagccagagagagaaagactagggggacacagaattgaaaaagcgttttttggtcatagccggggtactgcttgtcatcgtcgtcgggattcaggtcaaaaatgccgttttcattgaatataaagtagaaggcgtcagcatgaatccgacctttcaggagggcaacgagcttttgatcaacaggttcgcccaccgctttaaaacgatcagccgatttgacatcgtgctgtttaaaggacctgacaaagatatattcattaaaagggtgatcgggcttccgggcgaaaccctcaggtatgaagatgatcagctgtatatcaacgaagaaaagatcaaagagccttatctggacgacttaaaggccgtcaccgccggaggggacttgacaggggattttacactgcaggaagtgaccggagaggagaaggtgcctgaaaacgagtacttcgtcctcggggacaaccggatccacagctttgacagccgccatttcggctttgtttcagaacgggacatcgtcgggattgtgacggaaagaattgataagaagtgattggagagtacgggggagagtaagcggccgaccaaggaatacgattacgcaaatgacgagcccgaaatgtcaattagtacaacagcatcaataatgacgcatttgctaaatatgaaaattaaaaggcccggatgattccgggcttttttccgtactacttcagcttaatggcattgatccgtttttgcagcttcgttttttcggcggatgctttcagcttgcctactgctgattgcgctgctgattttgtttttttcgttctcttttgttcggccgttttgactttggcctttgctgcagaaacttttttattataggctgcagctgcttgctttttcgcggtgttcagccttttttgcagatttgatttgtcttttccggcgggaagctcattgatcgctttttgcgctttgccgaggtttgagtctgttgccgctttttcagctttggcaacggcctgctttgcggtcttcaagaggcttgaacggaccgcgttgatctgtttttgcaaattcgttttgaaagtgccgctgtcgagttcgttgaccgctttttgggcggagtcggcattggttttctttttttgcttctcagcgagtttcactttgctttcggctgtttttttaagctgctctttaacagtattgagtctctttttcaaagcggttttatctgcgtctgcagggagcggttcgatcgctttttgtgcggtttgaatgtccgcttttttctttgtcttttccgcttgtccgacggctttttgcgctttttccaatggctgtgtgacctctttgaagcggattaatccgtagccgaacaaatgatcacggccgggagcgcccaaatcgcttgtataaaactgcattttcttgcgcagctcagcatttgaagcggttgggtacagctgtttcaaaagtgcaaacatgccggtgacgtgcggcgttgcctgtgaagtgccgcttccgattgcatagccgcgatcggaagatgtactgataatcgatgtgccgggagcggaaaactcgacggcgctgccggtgttggaaaatgaggcgatctgatttttttcattggttgccgagacggcaatgacgctgctgtaggcggccgggtaataaacggattttccgtttccggcatttccgctcgctccgactaaaatgattccccgtttgtatgctttatctactgcatcgtggagaacttgactgtcgcctgaaacgacgaggctcatattgatgatatcgattccgtgctggatcgaccaatcgatgccttgtaagatacctttcagatcccccgcaccattccggtccagcgcttttacggcatacagctgcgcgccgggcgcgatgccgtcgatcccccgtccgttatgcttcgctccgatgattccggcaacatgggttccgtggccattatcgtcacggtatgaagcggtatagccgaccatcgatgcaccgccggcgatcgacagctcctcatggggggaaatcccgctgtcaataaccgcgatcttcacctgttttccggtcaaacctttattccaagccagtgcggcttgaatcagcttgatgttccactgtgaaaacgcggaggcgttttgcgctgtgctgctggagaaagcttttagagcggtgctgtcggcagcagctaccaggaggttgtcttcgacatacaggacgtcgggatcgtgttcaagttcgcgcactgttttgtcgtccgcagtgacagcggctgcgggaatgtgccggtaaacgtgttctaccgtgtctgcctgttcgatgacggtttcttttccgctggtatttttatatacaacaatgacctcgttttcctgcttattgctttccgcttgaatgcggggtgaatttgcgaaaaaaccgacgaacattgcagccgaaaccgcgattttccataactttttcatccggctctcctccttttttagcggcgttcgctatatatatcggaggatttttgaattttcaaagagaaagaaagcttatcttaaggtcgcttgtcatgcacctttagtttttaaaacgttaaaaacactgttatatcaacatttgtgaagcttcctgtttattcgggaagttaaattgagtactccaagttagttttaaaaaagagtcataaggccagcttctatcgatgaatcatttttaagcgacgccttttgtctaaaatgtataatgttacttttgtttttgttgaaagtgaacaatgttattgactggcttacaacctacaatttaattaaataaaaaatagattaaaagaagggagcgttctcataccgtggaaaaaacaattaaacatgaccccaattattacaaaaagataattattgcattgtgtttagggtgggtcgctatttggatttatcgtacaatacttacgccaatatatccgcagattcaagaatcattagggaatattagtgacacgcaaatagggttggttgcttctatttatttctttgcatatacgggtatgcaaattccatcaggagcacttgtcgataaatttggacaaaaaaaggtgttaattcctgcatttatcgtttttgcgctggctacatttgtgattggcacaagttcaactatcatgcaagtatacattggttcgttattggctggtatttcgactggttcatattacggtgcagccttttccttatcagctaaacatacgccaaaagataaaaaaagcttttccaatgcgattataaatagcggttcagcattagggatggtaattggactaatcggatcatcggttttagtaggcggttttgaaattcaatggaattatatgctttttataacagctatcgttatcgtagctgtaacatttgtgtttgtgctgtttattaaacaagataaaacatcagataaggaagtggctgaagagaagaaagacactgtacaaagcacagatattcaaaatgaaagcttattttctccaagacaattagttgtatattttgtatattttgcaacatgctatggctattatatgattgtaacttggttgccgtcctttcttgtagcagaaaaaggatttgctcaaggttcagtaggatatgtagctgcactagttgcggtcactgcagtgcctggtgctttgatatttactaaatatatagacaaaaatgcacatttgcgtctgcgtttaattttatttttattaattgcagcagcagtaacaattagtttgacagtgtttgcaccaaatcctgcagtactgtatattgcgttaattttatatggcttattaggtaaacttgcgattgatccagttttaataacctatgtatctgattccgtatcaggagacagagttgccagagcattaactctctttaacttctttggaatgagttcatctgttattgcaccaacacttactggttatattggtgatgtaaccggctcgcgagtattagcattctatattgcaaccattcttcttgcagcagcagcgttgctatttttccttgtggttatgttaagacagaataaaacagcagctaactaagagaacttccagtggtgctcctttgtattcacaacgatattttctctgaagcaaataacgccaaacgaatgctcagtgatgtatcaggagactctacagattgacctaatatttcttcgcattttttaatacgatatttcacagtattacggtgaataaaaatatcttctgaggtttttgtaagatcacattggtttgccatatagacacttaatgtgaatcttagttctttttccttcgttgtctgaggataggctaaaggaccgagtgtataaatgataaatggctttaatttattcgttggaatgagttgtaataattcttctacgcttttggatttgtagggctctataaattccatttcgccttgttcatatttattatcataagcctcattcgcttcgaaaaaagacagtggcaattgtgaaagctcggaaacctcattaccaatgccaaatgaaagggagctattaaaaaatagctgatactctttttggatatatctgcagtattccaaataataatgatgtcttctttgcagaagtatcgtaaatctgcgttctccctgagacatatatatgctaatggaagggtcaattccagtaaacttatgcgtcagccactcaaaagtcatctgatatcgctcatttaagtaggcgctattttctacattcttttctttgtcaatcccgcaaataatcacttgatagaatgtagaaggttgaatgtgatatttttttaaaagatcagtgtgttgtgctagtgaaacaaggttgtcaggatgttcggacataagtgttgtgaaaaaatggttcacgtcctgctgctctgcttccttgattttactatttttataaatagcgagactaagtgtgttcactgcctgttctattgttaataaactaatcggatagttgagcaaattaacatttgaaatcataagataatacggaaaatatttaaatgcaggaaccttaaatacagcatattcttcctggaaaacaccattatgatttggttcggtttgctctgaatttaaatatcttctgaaataattaaggtttttttgaacatgttctgagttttgatgaaagtgatgactcgatgattcaacttgatgaaaagaatttagcagcattacaggaacctttatgagtctacttaaacgttcaatcatcatgttcaggctaaacccttgcattagcatagcatttaactcttgttggatatctaatgcgaagtgtaatttttctgtttcttcatccaagataaatgaagatatatgatgagtaatggatcccaaattccaactttccggaatttcaataattgggaattttaatttatttgcaaatgcaataacctcatcatctaatttttttaaaaatcgggatagcttgatacctagaccagcaacttgtatatcatttaactctctaataagattgattagtccggattgatcatcctgatagctcattcctgttgtgacgataagtgagtgcggcgttgtaaaatttttaatatcaggcgtttctgtaatatcaaccatttctaccactcgttccaaatcgccctgctcattcagcaatgttaaatctgaaaattgcagtacagataatatttcttttaatgttgtcataaaggctgcctccttatctttgttagaaaaagataaaataaaaatgaaatatgtaagatattacaaggataacttttcaatctgatagtacactgtttttgaaggttattatacgtataatcctttagttaaaaatattaaaggagaatcattatgcttgaacaaaatcaagatattcatcatgattcttcgttttttgaaaagtgtggttattataaagatatcatgccgaagatcacttgaacaaagaaattcatcctcatttaacgttgcagtgggagcagggcgtaatattcagaatgatatagccgttggtggtctttttaaaactgggatcattaccgctaaaattaatggtatcccttattataagttccttcttagatagtcttaagactcgccgtaaacggatacaagggttcaaaacatatgcatttaagatatacctatggtgatataggtgctaactgcaaggtgtattacgtggtgctgcggattggatctcctcggtttgattgcagacatttgctggttcacaagctttattgagtggttccggctccacacaaataaaatcagcaaaaacataaattattggacaagtttccggtattgttgctgctcacgttttatttgcgttttcaactgtaaccattttaattggatgctctattgggtcaacaaggacggaatatactgaatgttgttaatcaataggatatatatttgcggtttccttgctacaggtgtacttctatttacagaaatctctatcaatgcagcaagtaatattattcttgcagcttaaaaaagaggaggatgattttgatgaattttgattcaattatcaaaaatggattagtcattctagaaaatggtgaacaagaagtcgaagtagggatcaaagatggcaaaatcgcagcaatcggtaaggatttgggtacaagtgcaaaaattatcgatgcaaaaggatctattgtatctccaggtatgattgatgcacatgtgcatatcacagagccgggcggcggctatcgtgatgaatgggagggctatgacacaggaacacgtgccgctgcaaaaggcggtgtaacgacgtttattgaaatgccattaaatcaagtgccagcaacggtagatgaggaatctattcaagaaaaatttaaagccggaaaaggaaaattatcagtagacgttgcgagttacggcggtttagtaccatttaacttagatgggggtattcaagaattagatagcaatggtgttgttgcatataaatgttttttagcaacatgtggcgaccgttctatagaaggagatttcatgaacgtagatgactattccctctacgaaggcatgaaacaaattgcgaagacaggcaaaatattatctatacacgctgaaaatgccgcaattaccgataagttaggggaaatagcatctaaaaatggggaaacttcattgcgtgcttatgtagattctcgacccgtatttactgaagtagaaccgattagaaaaattattctatttgcgaaagaaacgggatgtcgtgtacacatcgttcatatagcttgtgaagagggcgtagacgaaattgtcaaagcacaacaggaaggggtcgatattacatgcgaaacatgtacacactatttatatttctataaagaagaactagataatatcggaccggttgtaaaatgctctccgccaatccgtgagcaatcacgcttagaaggcatgtggaatcgggtattaaacggagatatttcattcgtaacatcagaccattcaccatgtaccccggacttaaaagctacggataatgcatttgaagcttggggaggtatcgcaggtttacaaaataatgtcgatgtattatttgatgaaggtgtgcaaaaacgtaatatgccattatccaaatttgcagccattattgctacaaaccctgcgaaacgttttaatctcgcatcaaaaggcagtattgcagtagggaaagatgcggatttcgtatttattaagaaagatgcaccttatgaattaaaagctgaggacttagcatatcgacacaaaattagtccgtatattggccgcaaaattggtgctcaggtagtgaaaacaatccttcgcggtgtcgaaatctatgataaagaaaaaggaatttcaaatgaaaaagtaggaagatttattccttaagtgacggaatagccatcccgtcaggaatttgaggcataggaagatgtgaaggcgacctgagattgtgttacactcgcaaatcagtgtgtcatcagcatttcttatggcggctatacagctgaagtgagcatggtaaagtgacttcaccgcaatctctcgctattacagcagcagctgttaatcaaattaaaacgagtaaaaaatttccaatatacactaacagcttagaattgctgctgctcgtatgtattctgactcttggcatatcattttaaactaccctataaatcaatgttttttattgatttatagggtagtttttttatttgcaccttatttattaatgggtaggagagatgtgtcgctcccatctataaatttttaagcgagcgatctgtgattttctttaggagaaattcgatgcaaatttaatttgttattttttgagtttttatgtaatcgaaagccaacagtttctttttatctctggcattagcccattatttagatacctaaattgattaaaaggtgtctttgttaaaagtgcataaaatgcttttctattattgttggttatgtcaatgaatggtcgtaaacagggttctatgatgaaagtaaatagagaaaggaggagaaaaaaatagatattcgatcaacctttgaaacgttggataagaaattcacaagttttggcggtttagaacaagggggtattacgcgtctgttatactctcctgaatggattgctgcagttcgcgaactggaagcgacattcaaggaagaaggtttagaagtaagctttgatgatgttggaaacttatctggtcgccttgttggaagtaagtatcctgaagaaactattttaacaggatcacatatcgatacagttgtagaaggcggtcatctggatggacaattcggtatcttatctgcattggttgctgtgaaatatttaaaagaaaaacatggtcaaccattacgaacaatagaagtactatctctcgcagaagaagaaggaagccgattcccatatacattttggggaagtaaaaacttctttaacttagccaaaaaatcggatgttgaaacaatagaagatgctgatggaattaaatttgaagatgcaatgcacgaatcgggttttgattaccgtaaaacagatcatgttcgtgacgatattaaagcatttgttgaagtacatatcgaacaagggaaagtattagaggcggaaaataaagcgataggtgttgtaactgggattgttggccaaaaacgttacacaattaacttgaaaggtgaagcaaatcacgctggcacgacaccgatgtcattacgaagggatacagttgttgcatatagtgaaattgtaacagacttaacgaaacgagctagagaaattggggagcctcttgtattaacgtttggacatgtcactcctgttccaaacacggtaaatgtcgtccctggagaaattactttttcgatagactgtcgtcatattgatcaacaactattaaataattttgcgaaagaaattgaagataaagttaaagcggttgcagaaacaaacaacatgacttatgacattaatttatggatggatgaagcaccgtcattgatggataaagaaatcattaaaataattgaacaagcagctaaggccaatgtgggggacagctataaattgatgccatctggtgcaggtcatgatgcgcaaatttttgcggattttgtcccaacagcaatgctgtttgtaccttctattggcggaattagccacaataccaatgaagaaacgaagatagaagaccttgtgaaggggattgaagtattgaaagatgtattgtttgaactagcttataaggaataataatgaaaaggagccagatactcatgagttacttaaatcataatcaaggatacagagaaggtttattagaaacacgttcagtaataaaaaaggataattatgcggtaatcacacctgatggcttggttaataatgttgtacctggctttgaagattgtgatgtaacgattttaggatccccgcgtttaggtgcaaggtttgtagattatttggtaacagttaaaaacaagggcggaaacaaaacaggttttgccggtgatggtatccaatcatttgtgtacgttgaatatggtaaaatcaacgcttttgcggatggtgaaaaatacgaattagcaaaaggcggattcttatatgtgcctccacacttacaattgacatttgaaaataataataatggtgaggacagccgtttgtttttatacaaaaagcgctatcagccgcttgaaggacatacaccagaaatcgttgcaggtaatgtgaataacattaaacaagaagcctatgaaggtatgaaagaagtattaattcaagatttactgccaaaagaaatcgcatatgacatgaacattcatattctttcattcgagccaggtgcttcgcatggttacattgaaacgcacgttcaagaacacggtgcctatatattaagtggacgaggtgtttacaacttggacaacgagtggatgccagttgacaaaggtgactatatttttatgggagcttatacgccgcaagcaacctatgcaattggtttggatgaaccattctcgtatatttattctaaggatgcgaatagagatattaatctataaagaggggcaattttaatgagtgaaccattagtgtatgtagaacgtaatcgtctccggcagctaatgaaagataaattagtgaaagcaggtttacctgaagaacaagcggataaaacagctgatttactcatttttgcagatgaacgaggtgttcactcacatggtgcagtaagaatgcaatactattccgaacgtgcattaaaaggtggatataacctgaaaccaaacttaagcttcgaaaaaacgggccctgcatcggggatttatcacggagataatgcattagggcattatgtgagttatcaagcaatgaaaaaggcaatcgaattagcaaaaacatcagggatcggtgttgtcggtgttaaagaaatgggacacagcggtgctattggttattatgcacatcaagcagcattagaaggtatggcggcattaacagtatgtcaatctgatcccatggtcgtgccatttggcggcaccgaaccatactttggcaccaacccaattgcttttagtgcgcctagaaaagacggtagtccaatcctttttgatatggcaacaacggtacaagcctgggggaaaatcttagatgcaagaagtaaaaacaaatctatcccagactcatgggcagtggataaaaatggagcgccaacaacagacccgtttaaggtaaatgcattattaccaatggctgggcctaaaggatacgggttagcgatgatggttgatattttatcggggagtttgctcggcttgccatttggcaagcatgtcacttctatgtataaagatttatcggagtaccgtcgattagggcagcttcatctcgtaatcaatcctgaatactttggtgggaaggagcaattcctggaaaaaatatctcaaatggttgaagaattacatgacaacccacctgctgaaggatttaacaaagtgtattatcccggtgaaattcaaatagatgtgatgaaacagtataaaaaaacaggtatcccagttacaaaggaaattttagattatttagagtcagacaaaatttactaatcatgtaatgaagggggaagcagatgcgcgtatctaagcaggagctgtttcatttaatcaaacagaagctgatcaaagctggattaaacgaaggagccgcacacgatgtttcagatgtattgacattcgccgatcatagagggatccattcccatggtgcagtacgtgtggaatactatgccgaacgaatcgcaaaaggcggtattacagcaaacccaaactacacatttgaacaaacaggacctgcatccgccgtctttagcggagataatggcccaggtcaccaagcagcaaaacaagcgatggaaaaagcaatcgaaatggcaaaaaattcaggtgttgctgttgtaggcatgaagaatatttcgcatagtggtgcattgggttactttgttgaaatggcagcagaacaggacatggttgctttaagcatgtgccaatcagatccaatggtcgtaccgtttggaggaacagaaccatactttggcaccaatccaattgcttttagcgcaccatcggctgatgaacgcatgatcacatttgatatggcgacaactgttcaggcatggggaaaagtattggatgcaagaagtaaaaatgaatcgatcccggaaacatgggcagtagatgcagccggtgcaccaacaacgaatgcaagagatgtccatgcacttgtgccaattgccggtccaaaaggttatggattgatgatgatggtggatgtcttatcaggcagccttcttggagtacctcatggcgtacatgtatcttccatgtatcaagacctgacaaaaggccgagatttagggcaaattcatattgtgatcaaccctgcatacttcacagatttaactgcttttaaacaacagatttcgacgatgcttgatgaattaaaagcacaaccggcagcagaaggctatggggaaatttattatccgggtgagcgcggtaaattaagaagtgcaaaatatgataaagaaggaattgaaattgtagacgatatttataactacctcgtttcaggcgatgttcattacaatcgttatcatggaaagaatagatttgcagaataacaaaatggaggatcattatgttatacacaattataaaagaaaacacctatcaagattctatcgtgttaatgcttttatcaaacaagttatctgcaatagatggtataaacaaagtttctatcatgatgggaacaccagctaacaaagacatttttaaatcttcggggttgggcacagatgaattggaaaaagcaaacccaaatgatatcgtcatcgttatagatacaaaccaagaagaaaaggtatcggaagtgaaagaagaagtagaagcagctttaaaaggagactctgcttcacaagacagagctaaagaccaagaagcacataactggaagcgtgcaatggagcttgcgaacaaccctaatctggcattgatctccattcctggtcagtatgcagcaatggaagcggaaaatgcattgaatgaagggttacatgtatttctattcagcgacaatgtatctaaagaagatgaggttaagttgaaacaaaaggcgcatgaaaaaggattattagtcatgggaccagactgcggtactggaattattcacggcgtgccactggcatttacaaatatcgtgaatgaaggagatattggcgttgtgggtgcatcaggtacagggattcaggaagtgacatgcatcattgaccgtcttggtaaaggtgtaacaaacgcaattggtacaggtggtcgggatttatcaacagaggttggtgctaccacggttttagatagtatcaaagcattaaatcaagatccacaagtaaaagtgattacagtaatttctaaaccgcctgcaaaggaagtgcagcaaaaagtattaaatgtgttaagaaatattgaaaaactggttgttacgttatttttaggagataaaccaacttatcaggaagaaaatatttatcatgcgtatacacttgaagaagcagcggttgtatctgttcaattatccaatggcgacaaaccgaattttaaaccgacagtggctgaaaatgtaaacgtgtcgttaaaagattcacaagttggtattaaaggttattactcgggcggcaccttggcatctgaagcagctgtgttagtgaaagaggcattcaaagaagaagtacctgaagagaagaaaggtgcctatattctaaaaacaaaacatcatgaaattattgacttaggcgatgatatttatacccaggggaagccacacccgatgattgatcctgaaaaacgcatcgaaatgcttgaaacatctggaaacgatcctgaaacagcagtcatcatgattgataacgtcattggctatggcagtcatgatgatatgacaaatgaattagcaccagccattaaacgtattttagccaatgcacatcaggatggccgtgaacttgcagtgcttgtaacagttgtaggtacagataaagatcctcaaggttacgaaaagcaaattgaaaccttaaaagaaagtggtgcaatgatttgtgagacaaacgatcaaatggttcgtacagcgattaaactggcaggaggaaaagtggaacagccagtccttgacatacaaaaatttgaatatacccaagaagacttgacagtagacgaaaaaattatgtccttaatcaatacgaaaccaagtgtcatcaatattgggctgaaaagttttacagcagctgttcagaagagcggatcagagtgtgttcaatttaactggcggccaattgctggcggtgatgaaaagctaatgaaagtgcttcaatatctaaactactatgaaggagagacaatctaatggggtacaaaacaataaatgaagcgaacgaagctgttatccggaagatcatagcagctgaaccattcttgaccgatgttgtacctgccaagtctgtgattcctgaattagaagattatgtgttattacatgctgggcctccaattaaatatgaaaatatgacagatcctatgcaaggctcttgtgttggagcgattctttttgaaggatgggcagaagatgaagagggagcgcgtggtctgcttgaaaacaataagattacatttattccatgtcatcatgtgaatgcagttggaccaatgggaggcattacatcacctaatatgccggttcttgttgttatgaacaaagagagcggcaatgaggcgtactgtcaaatgaacgaaggcatcggtgcaatattacgcttcggtgcttatcatgagcaggtaatcaatcgcctgcactggatgaaagatgtgttgggtccagtgttaagtaaggccttaagaaaaattgatggaggcataaacgttaatgttttgatggctaaagctattgcaatgggggatgaatttcaccagcgcaatattgcagcatcattggtgtttttaaaagaagttgctccagtaattgtggcattagatgatgttgaaaacgaacaaagtgcagaagttatccaatttttagctgatacagaccaatttttcttaaacattgccatggcgactggaaaagcaataatggatgcagcgcgtacaatcaaacatggtacagtcgttactgcaatgtgccgaaacggtgaaaactttggcattcgtattgctggtatgggagatgagtggtttacagcacctgttaatacaccacaagggttatattttaccggctactcagcggaagatgcaaacacagatatcggtgattcagcgattacagaaacaatcggtgttggcggcgtagcaatgattgctgcccctgcagtaacgcgttttgttggaacaggcggatttaatgatgcgcttgaaacaagcaatcaaatggctgaaatctgtgttggagaaaatccgaactttgttattccgacgtgggacttcaaaggtgcgtgtttaggtattgatgcacgtaaagttgttgaaacaggcataacaccggtaatcaacacaggtattgcacataaaattgctggatatgggcaaattggtgctggtacagttcatcctccaatcgaatgttttgagaaagcaatcacagcatatgctgaaaaactaggttttcaaggatgattttacaggcaagtgcggttggttcaatcgcacttcagctattaattgagggaaaaacgtttactgtacacagcatttttgaaaaaggtttaaatattgttgatcggaatgatgaattgatatttatcggcacaaatgaaaatgggaccttcccatttggaatcttgcttgactcacaaacgaagcaaacattaaaagcagatcttgaagtgggagatacatttcacgttcgcaatagccatctttcccacaattgttttgaactcaattttaatgcggaaatacttccgttatatacagattttaaacatgcaaatataaataaattaaaagaaaacgtgaaacaaatttcatttaaatcgtatgaatctactgattttgaatcagctcgcgtgtcggacttgataaataaattacacgatccaactgaaaatttggaggaagagcttcgttactttatcggtcggggccaaggtttaacgccgacgggtgacgatatactggtcggtatattgtatggacacttcatcaactcttttatcgccgaaaaacaccttgaaacattgggaagtctaatcagagaacccttaacaacccttgtcagcacgcgctttttaacttgtgctatagaaggcttgtttagttcaaaaattacaaaattacaacatgattcatctttgaaaagtataaaaagtcttataaaagtaggttcttcttctgggatggatactttatatggaatttatatggctttaacaaaggagtgaaagaaatggggaaaagtgtagtaatcgcactaggaggtaatgcaattttacagccaaaacaagaagcaacttatgctaatcaattcaaaaatgtaatctctgcaacacgtcatatgattgaaattaaagaagcaggacataaaattgtgattacacacggcaatggtccgcaagttgggaatattattgctcaaaatgaagctgccaaaaatgtcgttgaaccgctgccgatctatgcttgtaacgcagaatcacagggattcattggttatatgctcgaaaaagctttaaaaaaccatattaaaaaacggggcattaccgcgaatgtagctacatttctaacaatggttgaagtggacaagtatgataaagcatttgaaaaaccaacgaaaccaataggagtattttattcagaggaagaagcgaagaaattggagaaaaaagggtttgctatgtcagaagatgcagggcgtggctatagacgagttgtgccttccccagaaccgaaagtgatccatgggatagaagagattcgacgtttaattgatgaaacgattgttatctcctcgggcggcggcggtatacctgtatatcgtgacgacagcggtctattacatggtcttgaagcagtaatagacaaagatcgttcaggattaaagctggcacaacaattaaatgctgatgttttcatgatgttgacagacgtaccaaatgtgtttatcaattttggcaaagaaaatgagcaaaaactaagccgaattacagtagaagaagcagaacaatatgtggcagaaggtcaatttcctgctggcagtatgctgccaaagatgcaagcggctatagaatttgcaaagttaggtaaagaggcaattatttgttcattgaaccaagcggcagctgcactagacggaaaagcggggacgcgcataacaaaataagacgatccgtgtatgttcataaggtggataaaaactaaaattcccaccttttcagatatgacgacatttgatctgtcattctgatcaaaaatttctgaacaatctttataatgggattctttatgctgcgcagacagatttcgaaaagaaacaatctatgaagtctaggatcgaaagtcaaaggattagtggaaaaagttgaaggaggaagtttgatgacaaaagaggcgggatcagttgaaggtaaaggaaaacaaccactggttccctattgggtaaaagttgttatcgtatttttcttcggttgggtggctctttatgcaacgcgaacaatattaaaccccattatgggggatattgaatcagcgttttcattaagcaaggcacaacttggcttaattatgagtatatttttcatcggttatgctggtatgaatgttcctgcaggaatattaggagataaaattgggaaaaaacgagtgttggttccaggtgttattctatttggctcgcttgcagcagttacagggatgatgcccacattctttctgtttatctctgcatggcttatggttggtatggctcagggggtatattatgggccgcaatatggaatatcatccgaaattatcccgaagaaccgtctaacattaggcagtgctgtgattaatgcagggatggcttttggtacttcaattggctattatatctccagttatgttgttggagaatggggattcggatggggaaccccattttttgccatcgcagtgccggttgtacttatcggcatcgcaatggcaattgtaattaaagacaaaccaaaaactgataaagaggttaaaaggagcgctgaaccgtttaagttttcatctttatttaatagaaacttaattttggcatatattattattttctgctctatttacggattctttatgattattacttggttgccatactatttagaaacagcacgcggtttaaccggaggaaatattgcctttgttgcatcacttgttccatgggcagcaattccaggttcattattttttagttggctgtcagataagttaggccggcgcaaaccagtattgctcatgatgttgccatttggtattttatcaacagctgcaattgtttactttgatagcttaccaattctgtatatgacactaattgtgtatggaattgtagggaaaattagcgttaaccccgttttaattgctgttgtagcaaataatgcaccaaagcaatcattaagtacagcatttggattctacaactttgttggaatgttaggttccattttagctccatatattactggctggctgacagacactacaggaagtatgaatataggattttattttgcagcagctctgttagtaatcgcgttgattgcaacatatttaatagacgaaagtaatttgccatctgttgataaagcagctaaacatcattagttagcaaaagcttatgacttctagtaaatgctcagtcagattaagtatgaagagactcattcactgcaattgcgcttcaagcggcacaacaaaggcgacagccagactgataagatgcatatagtaaaccattcggaattgagatgttaaaatttagcggcttctttcaaaacagcatggactaaaatgacgctggacaaagcagtgccctcagtctgggaaaagaaacacagacggaaaagaactgagctgcagcccggctggaggaaaaggaaaagtgctcccggggcagacatcctgttatacaccgatggttgatttcgatccgcgttcttcatatgcgatgtagaaacattatcaatccattaacaggagctctcacttattcctatacaagttcgtattcatatttgaagaagtagtgtataaaagcaccctttcagcaagggtgctttttgctgtcttatcagtcacggtttcacagctattgaagagtcatttgacctaataaaagagtgggaaaagtgggggattcaggaaactgtgtaaaatgaactattactattaatttatacagggaggaaaatatagtatgatatgaataatgaataaaatacaaaaaaattgaatatcggaagaaaggagctccatatgaacaagatcgccgcggaagaagtcgccaacatccttaatacatggtaccgcgccatcagaagaaatgatgctgaacagtcgatccgaatatttgaagaagtcaaaccgatgctggcagagatggaggaagaccaagaggttttaatctactattctctgctggaactgcggcataaaatcatgctgtatgatacgcggggaaaaaagatagaacagcaagaggagttaacgaacggcggcagtgctgcatcacatatgacatcctattactactacctgttttcaggagcttatgaagtgtataaaaagaattatgagcaggcgatcagcttctataaaattgccgagaagaagcttgctcatgtacatgatgaaattgaggtggcgcaatttcacgataaagtcggaaagctctactattacttgggccagaatatcgtctctttaaaccatacccggcaggcgatggaaattttcaaggggcatggcgaccatgatatgaaccttgtttccacttatattacgatggccggaaattatacagagatggggaaatatacagaggcggaagaatatttaacagaagccatccatacggtaagaaaagccggcgactgttttaaagaaatgcagctccttcataattttgccttgctttatgcggcgatggacaattcggaaaaaagcattcagtttttagaaatcgttttggatgatcaagcatatgctgcatcagattattatttcaatgctgtgtttttaatgatcaaagagctgtttaaagtcggagaccataaacgcgctgcagccttttacaaagaagggaaggaaaggtcgaaatccgcggcgaataaaatatttgacgccaaaatcgatattttatatgcggcttatgcaggagatggtgaacaggcggttaaagactgcaaagacaacattgaaatcctgtttcaaacaaagcaatacgacagcgccagagaactttcgctcttaacggccaatgtttacagatcaaagtcactttataaagaagccgcacatttctttttggaagcgattaaagcggaagaaaaaatgaaaaaagtggagggaatgtgatgaaaaaactgttcattgttgctgcgattgctgccgtcgtatgttcgggatggtttgcggcagaaactcactgggcatccggcgacatgcaggttgctgaaaagatggtcggttaaatcgaatactcggaacaaatatgaacatccgctcctgagcatcagggcggatttttttgggaaggtaaagtaaattaaggcataagaaacgcggttagacaatgaacacttcttcaccactatttagggtggtcaacctaaacaaaggtacgaaacctgtgctgactacttttactccgatgtcctttcagctattcttgtcagtaagatcattccccatctcttcaacgcctcaggcatcacctattaaaaaaatcataattgaaacttgtcagcaaatatgttgcataacacgaggatgtttccacaataattaaacattaagacttttttgacttccagaaggaagaacaagatatttatgtaaaatcactcttttattcaaaatcaagatctctttcttgagggttttgcttttgagtgaaaatcccattctaaatttgtccatttaatggtattatttacttatataataaagaaagtgggaaacaaaacgttgatgttaattgcttttgaattttaccgaactatactcccagcatgaagtatttgttattttcaatttctttagtgtgataggtgcatttgttggatatttaaagagcaacggaagtattcaaatgcccctcttaatgattgattataaaagaaagtgggaacacaaaaatgtaagccactttaaaaatcattaaagttttcacggattgttattgagttattcctttttttattgggattagatatggaagaaacaaaagaaatgatgaaactatgtttgaggtcatttcttttgatatcctattatcaaaattacataatcaaagtaaagagcagaccagcggcctgctctacttttatacgagccataagatgatttccgcaagggaatctgctgtttttttaggaactccggctttcactaaggcttttacaagagcgccttttgaagcactatttaatctttctgtggcatatgcaattttacgtgcatatttgtcgacgagtctcgctttagaaggagagagtggtctaatcgcccatttaagagtttttcccccaactctgcaaacccatccaaatgcttttatggcttttagagatccaccaataaggcctgcagtatgtacttgtccatcctgatttaactgattgtaagtttgaaattctggagtttgtgatgcaaattggatgaatgctttggaatcttctagagtagtaggctcttgatgtgtttccatatattcttgaagagaagctggcaatgtgacatacgtcgtttcggtaattgatgtggttgactgttcttgttcagcggctgagacagatgatgcgaacccactaaatcctgaaatgataagggttgtggccgtaagtgttatcacaccttgagaaaatctttttttctttgattacatttcaaattcccccaattatttgatattcttaacaagtaatataataccacaaaaagagaggaataggtataaatgggtgaaaaaaccaaagaaaaaaactactctattggggatcatatttttgcaatattggttgttcttcttatgtgtttatttcttatttcttccccttttctgatattcttcggagtctttaaattggtcgctttggcaccagatgtgtcaatcaatacaaaaggtacttttgattctgtgatcgttttattcaagttttttgttctcactgtggtagtcgtagggattgtagacgtagtgttttctcagattttattgaaaaaacgggggtttctcaattttgttattgaagctttgttgatgttttgtgttttttatctatatgtattgatttattcaatgcattctcaggagattgttatacggaataatggtgtattcttagtatctttatttttgtttattttgtatttgctaataaatgtagcatatatcgtttcacggcggttatataaggcaactatgaaaaacatacagaaaaagaacaactaaaagagcaggcagctgtctgctcttttaaaatttcaatcgccaaaagttccgtgtcttaatattgaaaccataaattgaatagactcttaatccgatttataagcacttcaggaacagcagccggatctagagaagtccaaaaagatcgcgattgaaaaaacttattttttttaatattgaaaacttttaccttgtttgttatgatttttttagtaaagtttagtgaatacggattccaaagacaggacgggatgaaaatggcgacgattaaagagattgcgcttcaggctaaagtatcaagcacaacggtttcaagggttctgaaccatgaccagtcattatcagtagcgcctgaaacaaggcagcggattttggatatagcagcccggctcggctataaaagcacgcgcaggcgccgcgaggtatatgcctcaggaagcggggaaagcccgcgcatcggcattgttgtctgccaatcacaggaagaagagctgaacgatccgtacttttattccatcaggcagggaattgaaagtgagtgttttgaaagaggagcgtttattacgaaatttattcagctgagcagcatccgctcgaatcagcctgtaggcgatgtcgacggcttaatcgtcatcggaaggatcaactttgccggtttgcagcagtgcatgggcgcgctcaacaacgtcgtgtacatcaaccatacagacaatgaagagctgcgcgactcggttgtcgtagattttgagaaggctacggggagggcgctgaaccatttgaaatcgctcggctatacaaggatcggttatatcggcggaagagaaaaagagcactttcgaatcagcgatcaggagacaagcgccattgaaatcgaagacaaacgtctgactgcgtttctggagatggccggttcggataacgcaaagcacatttatatcggcgagtattcgatgcagcaaggctatgaactgatgaaaaaagcgcttttagagaaaaacgttcccgaagctttttttatcgccagcgattcaatggccatcggcgcgctccgggcgcttcgagaatcgggactcaaggttcccgaagatgttgcaatcgtcagcttcaacggcattgaagcgtccgaatttgctaatccgccattgacaaccgtaaaggttcatacagaagagatgggccggacgggtgtgaagctgctgctcgacagactgaaaggaagggaactgccgctgaaagtgaccgtaccttcagagctgattattcgggaaagctgcggattcagcaaacggagctaatggtagaataaggcgctttccaaggaggtgacgcaaatggatttactaaattccagtaaaaaatgaaagcgctttttattcaccattaaaatatcataattggagtgaaattgatgaaaaaaatcattttctcttttgttctcctgatcattttgtctgcaatacttgcgggctgctccggaaagaatgccggaaagagcggagatgtcacgctcacaatgttttcgacaatgacaaacgacagtgaaaaaaacacgctcagaagcatcgcagatgattttgaaaaagaaaatgaaggcatcaagatcgatatcagctttcccggcccggactatgaaaatatgctgcgcgtcaaaatggcggcaaatgacatgcctgatttgttcgatacgcacggctgggcgaagatccgctacggggaatacactgctgatttaaaagacatggattgggtgaagcatctcgatccaaacctcgatccgattttgaaggatgaaaaaggcaaagtatatgcctaccctttcaatcaggcaaaagacgggatcgtctacaatgccggtctcttgaagaaatacggtctcaagcctccgcagacgttggacgaactgatgcatgcgctggaaacgatcaaagaaaaaagcaacgggagcgtcattcctttttggtttgccggttcagataaaggcgctttagctcagttttatgatcagcttgccaccccgctgctcatcacagatgatcgccgcaatgaaaaaaaagctttggaaaacggcacattcgactggtccgactacacacttctcgcagaaacctttaaagagatgcaggaaaagcaattgatcaataaagatatcctgacggcaaaaccgtcgcaattggtcgaattgatggcgcaggaaaaaatcggttttaccctctcagtcacgtcgatcggccctgatacgagggaagtcaatccagatatccagttaggcgtgatgccgacgcctgccgtttatgaaggcgacaaaccgagctggattggaggagagcgccataccgttgctgtctggaaagactcagaacacctcgaagaagcaaagcggtttatcgaattcgccgcacagcccaaatacgtgaaaaagatcgccgaagccacctcatttcctcaggcattaaccaacacagaagctgaaaactactattctaagttttatgatcaatatgaagaaatcaaaatcgaaccgtactttgaccgcgtctatctcccgagcggaatgtgggacgtcatgggaacgacgggacaggaactattggccggtacgttaacgccgaagcaggtatcggaaaaaatgaaacaggaatacagcagattacaagaacaatagaaaggatcgttatcatcatgataaaaaaagaagggtgaaatgatgagcgaattagctaaagaaaaaagtctgactattgtgaaaagtaaaaggagatatgtgaggaaaaatggatcgctctggtggatgtatcttcccgccttggcgcttgtatccgtctttatgatttatccgtttgcgagcggcattaaaatcacgttcacgaactggaacggtttctcacagtcgtatgactggatcggctttgcccaatataaacggatgctggccgacccggcgacatggcttgtcgtcaaaaacaccctcctgtacggattgggcagtacggttttccagaatgtcatcggtcttctctatgccctcctgctgtttaaaagcatcaaaatgaaagcgctgacaagaacggttgtctatttgcccgtcatcatcagcccgctgatcatggggtatatctggtacttcttcttctcctatgaaggaggcgccttgaacgatttgctgaaactatttggagcaggtcctgtcaacgccttgagcagcccggaaatcaatccgtggatcatcgtatttgtcaattcctatcagtttgtcggtatagcgatggtcatttatttagcaggtctcggaagcgttccgaaagatttttatgaagcggcgcaaatcgacggagcaagcggttttcagcaattttggaagattacgctgccgctgttgatgccttctgtcacgatcaacatggtaatcaatatcatcggcggactgaagctgtttgatgtcattttagcgctgacaggcggcggtccgggaaatgcttcgcaatcgatgtcgacttttatgtacgatctgtattttaagaggcaggatgccggctatgcagccgctcagggggttttcatggcggtgttgatactgctaatcagctttacggctctcatctattttaagcgcaaggaggtcgaagcctagatgaatcgccaagagaaaaagaaacgggcgctgtggactttgctggctgcatggattaccgtttttcacctgattccgttttatattttgctgacgacggcgctgaaagcaaagggagatttcagttcaaaatggaagttcccggacgaaatcagcctcggtaattttgcagaagcatgggataaagcaggtctggccggctcgtttttcaatactgctgtgatcacttttgcttcggcggctctgctcattgtgatcggctctctggcggcatatccgctcgccaggcgcagaacaaagctcaatcaagccgtttacttcctgtttatcggcattatgatcattccgccgctgacatccatggttcctttatacaaaatggtggtggagcttggcatgctgaatacgcttgaaatcgcgatattgaataatacggcggcttatatgcccttgacgatttttttgtatgccggatttatccggtcgacgattccgaaagagcttgaagaggctgcgagaatcgacggggcgagcacggcggggattttcttcagaatcgtctttcctttattaaagccggtgactgcgacgatttgcattattgcctgcgtattcatctggaacgactatcagttttcgatctttttccttcaagacaaaagtgtgcagactttgactgtagcgattgccggcttctttgggcaaaatgcgaacaacctgcacttggtggccgcggcttcgctgatggcgatgctgccgatgacgattctatttttattcctgcaaaagtactttataaaaggattatcagcaggagcgctaaaaggctagcgaaaatttcacggggaaaggaagatatgaatgactaaaattgcttttatcggagctggaagcacaatttttgcgaaaaatgtgctgggggactgtctgatggttccggcggtcaacggatttgaatttgctttgtatgatatcgatccgaagcgcctcaaagaatctaaagatatgcttgagcatttaaaaaaccgctataatgacacggtatcgatccgcgcctatgacgacagaaaggaagctttggcgggagcgaaatacgtgatcaatgccattcaggtcggcggctataaaccgggcacagtcatcgattttgagattccgaaaaaatacggcctcaagcagacgattgccgatacggtcggaatcggcgggatattcagggcgctgcggacgattcccgttttattggatatggcaaaagacatcgaaagcgcggcgcccgacgcctggctcttaaattacacaaacccgatggcttctttaaccggtgcgcttctccgctacacggacgtgaaaacggtcggtctctgccacagcgttcaagtatgcacaaaagatcttttcaaatccctcggcatgaagcatgaacgaatcgaagaaaaaatcgccggcatcaatcatatggcctggcttcttgaagtcaagcaagacggaagagacttgtatccagaaattaaaaagcgggcaaaagaaaaacagaaaacgaaacatggtgacatggtcaggtttgaactgatggataaattcggctactatgtgaccgaatcgtccgaacataacgcggagtaccacccttattttattaaaagccgttatcccgaactgattgaagaactgaatatcccgattgacgaatatttgagaaggtgcgagaagcagattcaaaattgggaaaagatgcgcggcgaaatcgtcggcaatcggcatttaacccacgagcggtcaaacgaatacggctcaagaatcatagaagcgatggaaaccggccagccgtttacattcggcggtaatgtcttgaataaaggattgattacaaatcttccggaaaaagccgtcgtcgaagtgacgtgcgtcgctgagcggaaccggatcactccgtgctacgcgggcgagctgccagaacagctggctgctttaaatcgcaccaatatcaatacacagctgttaacgattgaagcggcaacaacaaaaagaaaagagcacatttaccatgctgcattgcttgatccgcatacggctgcggaattatcgatggatgatatcgtaagcatgtgcgatgaattgatcgaagcacacggcgactggctgccggaatttgaataaaaaaataaagcctgagcgaagggatcagccttcaactctggcttttttcacgcgagggtgtgtatatttttccgatttttgatgaagcaatcggaagaatggaggaagcattgcgatcacgagcaccaccctcaacacttggacagcgacgacgaacgtagagtcggcgtgaagcgtgacagacgttgtcgccatttctgcgattcctcccggagcaaacgccaatatggccgttgtcagcgaaatgcctgccgctttggcggtgacggcggcgcttaaaatcattgcaatgatcagtccgacggagctggcaagtgcgacgatcagcgtttttctgacgccgataaacatatctttgctgatctttgaaccgatcgttgcgccgagacaaatttgcgacagcactgaaaagccgtggggccaccaggcggttgtgctgagtccggtcattgaggcgcccgcgatttgcagaacggccgcgccggtcatgcttccgagcagccatggcgcaggaaaccgcagtgctttcatagctttgcataccccgaatccgcccagcacgatcaacgcagtccatgcgatatgaggcgcttcaaatgccgatgttcccgcggccatcacttggctgccggcagcatgggcgtcgggatgcttcgcatttatgaaaaaaacgaaaaagggaatggtcatgacgacgagaagaacacgtatcatctgcacgagactgacgattgccgtgttcgctccgacttcctgagcgatgcccggcatcgcggaaagcccgccgggagccgttcccacaaagctcgtcagcatatctgtcttgctgaatctccacaagacaaagcccgacagcatggcgaacacgacggaaaggagaagcatgacgccgacaatcagccaattttccttaaagatcgaaatcacagacatgttgattttttggccaagctcaattcccaatagcatttggccgaactgaagccatccatggtggatgccgttttgtctgaccgccgctttcaacggtgacgggcgaaacagcgacagacaagcggcggcggtcattgttccgaccatccagccgattgtcatgccggtcaatgagagaagaaatcccccaaaactgctgatcaatatcaataatatatcccgaaggaaatctcttttttccctcaaatgaaaaaccttcttcctgtttactgcggaatcattttgttcactaagtaaagtatttctatatattactatataataattttagtgattggtaaaatacgaatttatttaaaagattaataagaaaaactaatcgtttatttttgaacataacagatcgaatatatgaatacattaaattagattgatcataaatagaggtgaaccgatatgaaacatcccaaggaatcattcaccaaagtcaaatcgtatcgcccgtttcacagcgcctttgatccgtgtccgccgatcggcaaaagatactacagaacccctccaaatctatatctaggttttcagccccgcggccttccgcagttttccccgatggaggcgctgcaaaaagggacgctttggcccgtattttacgatcattatgaaaatccgtatgaagatgggaggtaaggagggtgacgaactctttaccgcaagactattataaaaggcttcatgaaattcaggctgttgattttgtcatcgttgagctgatgctataccttgacacacatcccgatgataccgatgccatcaaacaatacaaccagtatgccggattttccagaaaactgaaagcgaagtttgaatcaaaatacggccctttgattcaaggaagcccggatcagacggaatcctattggagctggaaaagaagtccttggccatggcaagtttaatagaggaagggagtcaggttcatgtggctttatgagaaaaaactgcagtatcctgttagggtgagagaatgcaatccgagacttgccaaatttttgattgagcaatacggcggagcggacggcgaattggctgcggcgcttcgctatttgaaccagcgctacagcatacccgataaagtcgtcggactgctgacggacatcggtacggaagagtttgctcaccttgaaatgattgccacgatggtatataaattaacaaaagacgcgacgcccgagcagatgaaggaagccgggctcggcgatcattacgcagaccatgacaaagccctgttttatcataacgctgccggcgttccgttcaccgctacatacatccaggcaaaaggcgatccgattgccgatttatatgaagatatagcggctgaagaaaaagcgagggctacgtatcaatggctgattgacatgtcggatgatccggatttaaatgacgggctggcgtttttacgggaaagggaaatcgttcattcacagcgcttccgcgaagctgtcgaaattttgaaggaagagcgcgaccgtaaaaaagtgttttaaacagcaaaaagccgaaaatacgaccgtattttcggctttttatttactgcaccgggctcgcaagcagttctgctgcgcggtcgcgcagcacatatttttgaacttttccggatgcggtcagcgggtattcgtcgatcagaaatacgtactccggaattttataatacgaaagctgtcctttgcaaaaatctctgacgtcttcgagcgtcagctttttgcccggcctgcatttaataaaggcagccgttttttccccgtacttttcatccggaacgccgacaacctgtacatcgacaatatcctcatgttcataaaggaattcctctatttcacgcgggtaaatgttttccccgccgcggacgatcatatcttttaagcgcccggtaatcctcacgtatccgtcccggtccatttctgccaaatctccggtatggagccagccgtcttcatcgatggccttttttgtggcttcatccattttatagtagcctttcatgacgaggtatcctcttgtgcacagttcgccctgctcatccgggccgagcgtttccccggtgtcaggatcgacgattttcatttctacatgcggatgcacttttccgacggtctcgacgcggcgttcgatcgtgtcggtgacggttgtctgcgtaatcacgggtgaagactccgtctgtccgtatgcgattgtgatatccgtcatattcatttgcttcatcacttttttcatgacttctctagggcacggggagcctgccatgatcccggtccgcagagaagagaggtcatagtttgcgaaatcggggtgggtgagctcggcgataaacattgtcggtacaccctgcagccctgtacatctttctttttcgaccgtttgcaggacgatgtccggcttgaattcgatgattggcagcatggccgcgcctgacgcgacgcaggcaagcgtgcttaacacacagccgaagcaatgaaaaagaggaaccgggatgcacagcctgtcttcgctcgtcagccccattctgtcggcaacgatcgccgcattgttgacgatattgtagtgagtcagcataacaccttttggaaagccggtcgttcccgacgtatactgcatattaatcacatcatcgtgtgtgagtgactgctctcgttcaaaaaggtcggcatcagagaccgtttcgcccattttagcgatctcggcaaaagccgtcatatgttcaggggtctcgttcttgccaaggtagacgagatttttcagcttcggcagcttttcaggatttttcatgatctcatcgatcatattgatataggatgttcctttgtagccgtccatcagaaagagggtggtggaatcggaatgttccaataagtactcgagttctctcgcctgatagctcgtattgacggtgacgagcacagcgccgattcttgccgtagcaaactggagcagaatccattccggaatattggatgcccagatggcgacatgctcccctttttgaatgccgagcgcgagcagcccttttgcaattttagaagtttcttcaacaagctcctgatacgagtatcttaaatcgagctcagaatatacaaccgcttcatgattcggaaaccggccggcggttgattttaaaagcccgccgatcgtttgtttttttaatgtaaccatagtgcctccttgcctcccgaataaaatctgtttccattatagcactttgttctagtaccaggtactataaaggactagtttttttaaccgggacactgctcgatattgtgcaatccccccgagagccatgatccctgcaatggcaagaaaaagcgctgccccgccgaacttgatgaagatcatcccgcctaaaaaaggtccaattgtccgggaaatatcccaatgcgggccgaaaaatgcaaaatatccgccccgtatatgattgggagcaaggcgcgagacaaaggtttgcatgtgattcagaagcatgctttctgccgccgtaaataaaaccgcagtcgaaagcagccaaaagatcgatgaagaaaaagcgaaaccaatagcgtagcatacgtatgatatggaaacgatcgttttgatgttcagtccttccgtccatttgacgagcggaatttgcatcgtaatgctaagaagggcgcggcacactgtataaacagtcaaggtgaataggaaatcgtcaaaaagagtttcgagataaaggcggtagttggactccagctgagcatagaacaggctgacgggaaccgacaagaacatcaagggcagaacaggacggtgttgaagtaataccttttttgcggaaagaagattttccctctcgaaaagctcctattgcttttttgactgccagttccgctctatcaaaacaatatacgcgtcaaagcgggggtagctattcaaggcattgtgctgaatgaagaagggtggattctttttacggcgtctggtacaaaaaagaggctctactttaagagcccctccattgtgtctcttaatgaccggaatgtcctccatccgcagacttaatttccaatatgccatcaagaacgccttgcgtccgaaatgaaatctcattttctgacccgagaatgaatgcatggttgtatgggccgtcctgcggcctgtcatgaaatgaaggctcgatctcggacagatagctgtatagtgtgctgtctgcctgtccatttttgagtaaaagcaggggagcgtgttttcccaaatgggaaaatggcgctccggcaagcgcaagctcgggcgcagcggttgatgcaaaggatagtccgtgtcccggatctgtgatgccccagccaaagccggtgttcttatccctgaatttcgcaaatgcaatcgaatttgcgacaggagtgtctccggaaattcttttgactgttccgtattcctttaatgcattctccgttttttccgaaaccgcttttttagggccgagaatatagatgtttgctttggcgtcccttttctttaatgcttcagccgtctcttcgggaatgccttttttgttcacgtacaggatcggctcaggcatgtgggcgatccagtttacagccgggagcgaataaagttctgcatcatcctcggatgatccgatgatgacgcttttcggatattcaccggctgcctccgcgtattctttgtcaatctcttttgccagatcagccgcgttcttccctttgagctcttttattttaaaagtgttcaaagcttgaagcgcttttgaatcaaattctccgacagccatgatttgcgtcccgtctgaagtgcccgtcgggttcaagcgtttgatttcattctgaatttgcccggagattttccctttttccgcgattaaaacaggcccgttatttggatgatggatcaaatctgctgatgcaagagctgtctgccatgatccgcccgaaactagaatcactgcgctcggcctgttttgtttatgagtggccggccatatcgtttgagaggttttgatgctcatgtcttctggtgtattcgcgtcaagccttgtcgagttctttgtgtttttcaccaggagcccctcttcggcccgcttattgaaatcactcggaagagaatcagcgtctttttctttcatctccgaatgatcctttgtatgatgctcctcatgtccgccagtgtttcccgagccggaattttggcatgccgcaagcggaagcgcgaaaacaagcatgacaaaaagtaaaccgaatctcaatttcattgtgttttccccctttttggttcagattactgagtagtatacccgggaaatgtgcaaaactggtgcagacatctcgacattgttacacatcggaaggcagcgtgatgataaattcgcttcctttcggggttctgtttttcgctgcaatctgaccgccatgaagctcgacgatttctttcacgatggccagacccagcccggtaccgccggtttgtctggacctcgatttatcgatccggtaaaagcgctcaaatatataatcccgttcttcttccggaatgccgcagccttcatccgctaccgtaatcttgacctggtcctccaattttgatgcggtgacggccgctgttgattcaggatcggagtattggcgggcgttgttcagcaaatttgagatcacttgtgaaaagcggacctcgtcgactgtgacataaagatccgtcgggatgtcgaacgaaacgctgattcgcttttccgaaaaagcgaccgccgctttctgaatttcttttttcacgaatgtgtaaaggtgaacttgtttcttattgatttgaaatccgggctgtttcagttttgtcagcaaaaataaatcgtcaacaagggtgtttaaattgtccgcttcctctttgatgatcgacaagtactgatttctggcttgcggttcgagcttatctctcatcgcgacatctgtgtagccttttatatatgtgatcggagtccgcagctcatgggcgacgcttgacagaaaatcgtttcgctctttttgaagcctgctgagatttgaggaaaggctttcgattgatgcggcgagctctccgagttcatcattccttttgatatcaagcggaatcgaagcctgaccgtttttgatgctttcggttgcctccttcagtttaataatcggcttcgctaaaacacggctgtaccaaagaatagctgcgaccgttaagacgccggttaagccgaagctgaggaaaaaccgcttcgtaatgcttgccaccaaggcttttatcgaggaggtctccaaatacatgaagacgtagccggccgtttcccgtccgttcatgatcggactgatcgtacaaatgtactttgatgtattccaatgggaagataaagcggtcccgttcctcgggatgttctgttcttcgaaatgaaggtgttccgtcatgtctcccggggcagactgcgccaatacgcgtctgttttggtccgtgatgatcacgtttgtccgggcttcagtctccatcagggtgacgtggtctatcgtccttttgtcaaaatgcttttcgaggacgtctctgtggctgttgcctcttagttgaagcgcgcttatttcttcgtttattctcgtgttgacaatcgttgtatacagcgcggcaaaaaggacggcttcgatgaaaaggattaaaacgaaaaatgaacctgcgagctcaaatgaaatctttttcatgctccggttcctttgcttgtccatttgtagccgacgccgtagacggtccggagatggtcttcaaccggaaagcccgcttttttcaatcggtgccgcaaatttctcatgtgcgaatcgatggtgcggggctcgatatcagagttgaatccccagatgttctcaatcaattggtctctcgaaagcacttgatccatatggtctaagagtgttccaagcagatcgaattcacttggcgtaatgctgatttcacggtgattgacatgcagggtatgatgctgtttattccagattaaaccgcggaacctgatttcatgaaatcggcgggttctgcgcaggacggcttctattttggcaagcagcactttttcgctgaacggctttgttaaataatcgtctgcaccgcagttcaggcctcgtacaatatcatcctgcccgttttttgccgtcagcatgataaccggaatgcttgtcaatcttcggatctctttgcaaaccgtccatccgtccatttcaggcatcatgatatcgaggatgacaagatcgaaattgcgcatttttattaagtccagggcttcttttccggtggcggcttttgtgcacgaataatgctctaaataaagctccagcagatcgagcatccggttttcatcatcgacaagcagcacgttcaatgtctagcacctctttagtcaaaatataagtccgctattttaaaaatataccctataagggtatattgatcaaggcggaacgaactgaatcacctctttgacaagaagtataaaaaccagactgcatggttttgttcgtcagctgccgcccgcttgaacgcatcccgtatcgcccggtctttgacatagtctgcgatgtccaaataaaaatcaaccgtttcctgctcgtcttttaatgcggactccagcgcgttccaatactgttccggacaaggctccgtaatggaaatgtcaggctttcggccggcaagaggcgtataaaatgccaggaacgcattaaagtggcggatttcgtcctgtctgatttctaaaatttgctgttttgcctcagcatccggggccttttgtgcgattttttggtagcagacgaccgcactgtgctctccgtttaccgctttttctagatctttgatcagcctgttgttttgcctggcgggataggcgggatgatacggctgaacataccacatgtttttcacctcaatatcttatatttcgccgtcctgtcattatatgtaagtcgaagcttgcatgtgcctactggaagggcgcatctcggacatgtggcaaaatggtgtggggagagcgcaatctattttaaaaaaatgaagtttgacgtaaaatggttgttagtgccgaatggtgacatacatatcaaaatggagtgagactattgaaaaaggcaatattgacggtcatagctgtattgacgtcggttgttttgttcgccggctgccaagcggaaaaagggggatcagccaaggggcagtctgaaaaagttcaaattacggtttccgcggctgcgagtctcaaggatgttttaacagaactttcctccgtctatgagaaagaccatccgaatgtctctataaagtttaattttggttcatcgggtgcattgcagcagcagatcgaacagggcgctccggctgatttgtttttttctgccgctgaagacaaatttaatagagtagttgatcaagggttaattgacaaaaaagactctgtcaagctggtcgaaaacagtctggcgctgatcgtgccgaaaggaaaaagtcagcatgtcaacagcttcaaggatttggcggatgacaaagtcgaaaaaattgcgatcggcaaacctgaatcagtgccagccggaaaatacgcaaaagaaacgttgacgaaccttgacgtatggtctaaagtgcaatctaaagtgcaatctaaagtcgtctacagcaaagatgtaaggcaggtcctttcttatatcgaaacaggcaacgcggatgccggaatcgtttaccggacggacgccctttcatcagatcaggtcgagaccgtagagacggcgaaaagcgatctgcatacaccgattgtctatccgctcggaattgtgaaaaatacaaagcacagggaacagtctgaggaattttatcaattcctgcaaagcgaccaagccgttaaggcaatggaaaagtacggatttaagaagggctgaccgccgttatgcttgaggaattcttttccccgattgaaatttcaattcaagtatcagtcgcagcgggcatcatcgcagttttgcttggaactgctgcagcgaggctcctggcgaacagaaactttaaaggcaagtctgttatcgagacggtaatgatgctgccgctcgttctgccgccgaccgttgtcggattctttttaatcgtgatcttcggaaggcagagcgtgatcggacgcttgatagaaaacgtatttcaagcaccggttatttttacctggtgggcagccgtgatcgccgctgcggttgtcgcgttcccgttaatgtatcagtcagcaaaatcaggattttcggctgtcgaccgcgatatcgaggatgccgcgagggttgatggagcaagcgagtggagggtgttcctctttgtcaccgttcccctcgcatcaaatggaatcatgacggggattgtgctcagctttgcgagggcgcttggcgagtttggcgcaacgctgatgtttgcgggtatcatcccgggggtgacgcagacggtgcctacggcgatatacttggcgatcgattcgggaaatatgacgctggcatggatgtgggtcgcctctatcgcgatcatctcgtttttgatgctgttttttgtgcagttcaagcaaaaatagccgtatggggtgcaagtgctcatacggttttttcccagttttggagaatggttattttgcagatgtttcgatagaataaagagtaagaaacagaaaggagacgagcttagtgggagcagtatttttatcaggcagatccgggagtgggaaaacgacctttatcctgaatgaaatcagagaaaaacttcgcgatgaaccgctcggaaaaccgatcatttttctagtcccggatcaaatgacgtttttaatggaatacgagcttagcaaaacacccgatttgggcggaactatccgcgcccaagtgtacagtttttcaaggcttgcctggcgagtgctccagcataccggaggcatgaatcggccgtttttgacggggacgggcattcagatgctgctgcggagactgattgaagagcataagggcgagtttaaagtctatcaaaacgcaagcgataaaagcggatttacggagcaggtggaacggatgctgaccgaatttaaacggcattgtctgcagcctgaaagcatccgggacatgatagaggggacgggcaaatcggaatacgaagatgaacggatcctttccgataaattgcacgacttatatattttatacagcaagcttgaggaaaatctggagaatcaatatgttcaatctgaggattatttgacgcttttggccgagcagattccgtatgcggatgagattagaaacgctgccgtttacgtggacggatttcaccaatttacgccacaggagatgaacgtgctggaacagctgatggtacatgccgaagagatcacgttttcgctgacggcggataagccgtttacggcaaacagcccgaatgatctccatctgttcaggatgaccgggaaggcgtactatgacctttaccaaaaggcgaaggaactcggccttgatccgtctgaagtgcggctggaagaaacgaaacggcaccggcatcatccggagcttcagcatcttgaacgctattttgatgaacgtcctgcaaaaccgtatcccggacagacggaatcgctccgcatcatgcaggcgtcgaacagaagaaccgagattgaaggaattgcgcgcgagattcattctttaatccgccagggccggttccggcttagggatattgctgtcatcgcccgcaatgttgaagattataaagatacgataaaagaagtttttaaagactgcgaacttccttttttcatagacggcaaggaatcgatgcaaaatcatccgctcattgagctgatccgttcgacgcttgatatcattaaaggaaactggcggtatgaagcggtgttccgctgtgtcaaaacggaacttttattcccggaaggacagccgaaggaacggctgcgcgaacagattgaccagcttgaaaactactgtattgcgtatggcattaaaggagacagatggacaagcaaagatccgtttgtttacagaaggtacgcttcactggatgaggattttgccaagacagacaaagagattgaaacggaaaatatgctcaatgaactaaagggctggatcgttccaccgatccacaggctgcagaagcgcttgaaaaaagctgaaaccgtcagggaaatggccgaagccgtttacctttatcttgaagaagccgatgttccgatgaagcttgaacaggaaaggcggctggccgaagaaagcggtaggattgcagagtcgcgccagcatgagcaagtatgggatgccgttattcaactgttggacgagtttgttgaaatgatgggcacagagcggatatcgtttgctttatttcagcaaatgattgaaaccggcttggagtctttgaaattcgcgctgattccgcccgctcttgatcaagtgtttatcggcaatatggacctttcaaggatgtacggcacgaaatgcacatttctcatcggtgtaaacgacggtatacttccggcgaggcctgcggacgacggcgtgctttcagacgatgaccgggagtggctgaaacgaaacggcgcacagctggctgcgacgggtcgagagcagctcttggatgagaattttctgatctacatgacgctttccagcccgtctgaaaagctctatgtctcctatccgatcgcagattcggaagggaagacgctgcttccttcaacagtagtgaaacggctgaatgagctgttcccggacggcgaagagaagatgctgattcatgaacccgagcagctggacgacgaagcccagcttgaatttctcgtgaataaaggcgccgccttgagccatttggcagggcagctcggcatttggacgaggcagtatgcgatcagcgatgtatggtggagtacatacaactttttaatgaatgagcctgaccgcatcttttctcaaaatatcctgtccagcctgtttttcagaaacaaggtcgaaaacttgaaccggcatgtgagccgcgatttatatggggagcacattcagggaagcgtgtcgcggatggagacgttcaaagcctgtccgttttcccattttgcttcgcacggtttaaagctgaaggaacgtcaatttttcaagcttgaagctccggatatcggtcagctgttccactcggcgctgaagctgatttcagatcggcttcacgagcttaaactggattggcgcgacttaacgaaagcccaatgcgagactttgtcaagcgatgcagttgaacggctcgcgccaaagctgcaaaaagagattttgctcagttcgaaccgtcatcattacgtgaagcagaagctgcaaaaaatcattgccagggtatcgggcattttaagcgagcatgcaaaagcaagcgggtttgcccccgtcggcatcgagctcggattcggggggaaaggtccgcttcctccaatgcgttttaccttgaagaacggctgcacaatggagcttgtcggccggatcgacagagtggataaagcggagagctcaaaagggctgctgcttaggattgtcgactataaatcaagcgataaaggcctcgatttggccgaggtgtattacggcctcgccctgcaaatgctgacatatctcgatttgtcgatcacacattcaaccgattggctcggcatgaaggcatcccctgcaggcgtgctttattttcatgtgcacgatccgatgatccaggcttcggtgccgctcggccttgatgaaatagaaaaagagattttcaaaaagttcaagatgaaagggctgctcttgggagaccaggaagcggtcaagctgatggataccacgctggaacaaggcaggtcgaacatgatcagcgcaggcttgaaaaaagacggctcgctccgttcggattctgacgttattgcagaagaggattttcatgtattaaggcgccatatccgccggacatttcagaaggccggcgaggagatcacagacggtaaagtgtcgatcgagccttacaagctaaaagaccggacaccgtgcacatattgttcgtaccggtcattctgccagtttgacgaatcgcttgaggaaaacgaataccggatattaaaacccgaaaaagacaacgtgattttggagcggctgaaaaaggaggatgagacagatggagatttctaaaccgaagggcagcaattggactgatgaccaatggaaggcgattgtctcatccggccgggacattttagttgcggcagcggccggctccggaaaaacggccgtgctggttgagcggatcattcggaaaataacggatcaggaacatcccgtagatgtcgacaggctgcttgtcgtcacctttacaaatgcatctgcggctgaaatgaagcacaggatcggcgaagcgctcgaaaaagagcttgccgaaaatccgggatcgcttcatttgcgccgacagcttgctttattaaacaaagcgagcatatcaacattgcattcattctgtcttcaagtcatccgcaaatattactatttgatcgatgtcgatccggctttccggatcgccgatcagacggaaggcgagctgctcggcgatgaggtgctggatgaactgtttgaagaagaatacaaaaaaggcaatcctgccttttttgaacttgtagacagatatacgacagaccgtcatgacctcgacctgcagcatcttgtcaagcgggtctacgaattttcccgttcgcatcccgatccggagggctggcttcactcattggctgaactgtatgacgcggcttcggatacgaaggttgaggctctgccgttttattcttacattaaagaagacatcgcactcgttctggaaggtatgcggcaaaagctgacgcgcgcgcttgatttgacgaagcagcccggggggcctgctccgcgcgccgaaaattttctcgatgatttagcgcagatcgacaggctgattcagcagcaggatgatttttcggccctgcatgagcttgtaccgaccgtttcgtttcaacgattgaagccatgcaaaggtgatgagtacgatcccagattggttgatgaggcggcagacctccgcaacagtgcgaaaaagcagcttgaaaagctgaaaagcgattatttttcgcgaactccggagcagcaccttgagagcctgagggaaatgaagcctgtcattcagacgcttgtccagctcgtgctggagtatggcaggcggtttgcggaagcgaaaaaggaaaaggcgatcgtcgatttttcagaccttgaacacgactgccttgcgattttatccgtgaaaaatccggcgggcgaggccgtgccgagcgaagcggcgaagttttaccgccatcagttccacgaagtgcttgttgatgaataccaggatacgaacctggtccaggaagcgattttaaagctcgtcgccaaagaggagcatgaggggaacctgtttatggtgggcgatgtcaagcagtcgatttaccggttccgcctggctgagccgcttttgttcctctcgaaatataaacgctttacagacgatggctcgggttccggccagaaaatcgatttaaataaaaacttcagaagccgttcagatattttggacagcacgaactttttattcaaacagctcatgggagaaaaagtcggggaagtcgagtatgacgaacaagccgaattgaagctcggcgcctcttatccgccgaacgaagcgacaaaaacggagcttctgctcatcgaaaccccgagcggcgcgccgggtgaagaggctgaagagcttgaggcggtccagcttgaagcaagagcgatggccgggcaaatccgcaggctgattacagaaaaatttcaagtatatgatgccaaagcgaaagcgtcgcgaaacatccagtaccgtgatatcgtggtgcttttgcggtcgatgccttgggcgcctcaaattatggacgagtttaaacagcagggaatacccgtatacgcgaacctctcaactggttattttgaggcgacagaagtatcggtcacactgtctttattaaaaatcatcgataatgcctatcaggacatcccgcttgcgtccgttctcagatcgcctgttgtgggtcttgatgagaatgagctttccttgatcagaatcaaagataaaaaagcgccgttttacgaagccatgaaagcgtaccttgctgcagcagacggcgatgagaggctcagcgaaaagcttcgccgctttgacggtctgctcaagaagtggagagcttatgcgaaaaaccactctgtagcagagctgatctgggaaatctaccgggatacgaagtatttggattatgtcggcggaatgccgggcggaaaacagcggcaggccaatttgcgcgcgctttacgacagggcgagatcctatgaagcgacatcattccgcggcttgttccgctttttaagatttattgagcggatgcaggagcggggcgatgacctcggaacggcaagggctctaagcgaacaggaagacgttgttcggctgatgacgatccactcaagcaaagggcttgaatttcctgtcgtatttaccgccggtctcggacggaattttaatatgatggacttgaacaaatcttatctgctggataaagagctcggttttggaacgaagtttatccatccgaagtggcggatcagctatccgacgctgccgcttatcgcgatgaagaaaaaactccgccgcgagcttttatcagaggagctgcgcgtcttgtatgtcgcccttacccgggccaaggaaaagctgtacctggtcgggacggcgaaggataaagaaaagctgcttgccgactggcggacacaagcggcggggtctgagtggctgcttccggattatgaacggtttcaggcgaaatcttacctggatttcatcggacctgctttgatgagacacagagatatggatgaatccggcgcgccgctggtgattgatgagatccgtgaacatccggcgcgctttcaggtcagctggctgtcggccgcggatcttcaagcagaagatattgatcaggccggtgaagaaagacacggccggctctcccaaattcaaatggggcttccgatcgatggttcgtttgagtatgagcaacaagtcagagaaaggctgacatggtcatatccatacaaagacgccgccaaagtccgaacaaaacagtctgtctcagaaatgaaaaggcagaaggagtatgaggatgagtacggcgaccgctcgctgattcgcccaaccaaggatgctctcctgtttaaacggccgtcctttatgatggttaaaggcctgaccgcttccgaacggggaacggcgatgcacaccgtcatgcagcatattccgctgacccgtgcgcttgaaatgaatgagctcagccgcctcctagacaggcttgttgagaaagagctattaacagaagaccagcgggcagcgattgaggaagacgatattctcgcattctttgatacggaaatcggacaaaagcttctcggcgcccgccgcgtcgaacgggaagttccctttaacatgacgctgtccgccaaagaggtttatcctgatcttgagtcagccgacgaacctgtattgatacagggaattatcgattgtttattcgagacggaggacggtttttaccttcttgattacaaaaccgaccggatacacggaaagtaccgaaacggattcgaaggggccgaaccgattttaaggaagcgttacgaaacacaaattcagctttatgcacgagccgttgaaacgatgattaaaatgccgctcaaagggcgtgcactgtacttttttgacggaggacatgtgctcttattttaatatgaaaccggcgtccccctgacgatttcggggggagctttaatgaaaagagaggtgaggcacacatgcgaattttacatacagcggactggcatttaggaaaaacgcttgaagggagaagccgcctgaaagaacaggcggactttcttgaagagctcacaaggatcgtaaaagatgaaaagatcgacgccgttatcatggccggagacgcatttgacacagtgaatccgcctgcactggctgaacagcttttttatgaaagcctctccgccttgtctgacaaaggaaaccgtccggtcgtcgtgattgccggcaaccatgataatccggaccgcctttccgcggcctctccgttaacgacagaccatggcatccacttgatcgggtacccgaagactgagccagttgaaatagaagtcgcttctagtggggagatcctgtcagtcgcagcgctcgcctatccttccgagtccagactgaatgaagtgctgtcggaaacatttgacgaaaaactgctgcgcgaccagtatgatgagaaaatcaagcagacctttcagcgtatgtgcggcaaggcgagaaaggatgcggtgcagattgcggcaagccatatttatgtggcgggcggcagccagacggattctgagcggccgatcgaagtcggaggcgcatatacggtggctgcggaaagcctgccggaaaacgccgcctatgtggcgctcgggcatcttcatcgcccgcagacgatcaaacgggcccgcacgcttgccagatattcaggttcaccgcttgcctacagcttttctgaagcgggatacgcaaaatcggtctccattgtcgaagccgcacccggtcaaacggcatcatgggaagaggtccatttgacgagtggaaaaccgctcgttaaatggaaggcggaaaaagggatgtcccaagtatacagctggctggaggaagagcgggacaaaaacgcgtggatcgaccttgaaatccatctgacagaccagctgtcgattgaagaaattcaccgtttgagaaaagcgcatcaaggcatcatccatattcgtccggtttttgaggaagccgcctcggatgaagagaagatccggtccagaaacgttccgattgaagaacggtttatagcgttttatgaaagacaaaccggtggagcggttcccgatgaggaaaccgtcaaactgtttctggagctcgccgcaggatcggaacaggaagagggtgatgaaacatgaagccgatttctctgtctattaaggggctgcacagtttcaggcaggagcaggtgatcgattttgagcgcctgtgcgatgccggtgtattcggtatcttcgggccgaccggaagcggcaagtcgtcgattcttgacgcgatgactctcgctttgtacgggaaggtggagcgggccgccaataatacgcacggtattttgaatcatgccgaagatgagcttgccgtatcgtttacgtttaagctgcagacaggccatgagacggcttataaagtggaacgggtctttaagcggacagatgccgtcaaggtcaaaacatcgatctgccgcttcattgaaatgaaagaggaacaaatcgttctggccgataaagcgaatgaagtaaaccggaaaatcgaagagctgctgggcttgacgatcgacgattttacaagggcagtcgtcctgccgcaaggtaaattcgccgaatttctttccttaaaaggagcggagcggcggcagatgcttcagcgcctgttcaaccttgaacaatacggggacaggctcgtcaaaaaactaaagaaacaggcgcaaacagctcagtccagaaaaaacgagatgcttgccgagcaggctggattgggcgatgcgggggaagaggcgctgaagctggcggaacagcatctcgaagaagccgaaacccttttgcaaagcaagaggcgcgaacgagatgcggaagcgcagcgctttgcggagtaccaggaaatttggaatctgcagcaagaaaaagaaagctatctaaaaaaagaggcggagcttttaaagaaaaaggaacagatccgggaaaaagaaagccgcctgcatctcgctgaaacggcaaatacgctcaagccttatgcagacgcctttctggcagcgcgggaagatgccgagcgcgcacttcgggaagaaaaacaagcgcgggaacaattagaacaatacgaagagcttcataaaaaaacagagtgcgagtacgagaatttcaggcgtcataaaaatgaaaaagaaccggagcttctcaagcaagaagaacagctcaccgctttgaaggaaattgaaaacaagcggcttgccgcacaggcagaagctgagaaaaagcagcgggaacagcgcttgaaagaagaggaaatcaagcatgcggcagacgaactggccaaggtgaaaagcctgcttgaacgcgggacagccaagcaaaatcagctgaaagcggagctgaaatctgtccaggtatccagcgaagagcgcaaaaactgccggaaggccaatcagcttgcttttcacattcagcagcttaacagcgatgccgctttagaaaaaaaacggctcgatcagcaggaggcgctgatcaaagagctccggcaagaacagcaagcggtggatcagaaggtgaaggatgaaaccgaacgcatcgaggcattgtttgccgctgtcgaacgagcgtatgcgctcgtttgcgaaacggacagatcgctctctgagaccgtccgtctcgcgactcaaaagaaagaagagattgtcgcaaaacggaaacaggcaaaccgtgatcagctggcaatcgaactggcaaagcagctcaaagagggtgagccttgtccggtctgcgggtctgtacatcatgaaatgcccgcgggtgtcggtacggaaagcccgtcctttaaagagacggaatccgaactggagaaaacggaagccatcatcgcagaagccggcgcgctggctcaggagtttctctcagccaaagtggcgctcgaacagcagtccggccacctgatgagcgaatgcccgtttttagtcaaaagcaaacacgaactgcctgaaactgctgcatcgctagaagaaggcaccattcccgaacggttcagccgcatcagctttgaatggaaaggaatcagacaggatctcgccgagacaaaaagccggatgtcaaagctccttcacacatataaagagctctgcaaaaaacgcgaccaaatcagcgaacgcctcagccatgaagaaaaagagcaaaacaggcttcaaaaccgcgtccgcgaattgaatgacgagttaaatgaacgccaaaaaagcttcggcgaacaattcggcggcctctcttatgaacaggctgaaaaatggcaaaaaacgattgaagaaaaagatctggccgcagaggaattcgaaaagcgaatcgaaacgagcgtcgaatttctcacggaacatgaacagcaaaaagagaagctcaccgagcgcttgtttgcgcttgataaagaaaagcttgaccttcattatgcggtcgaaagcctcaaaaaagacataaacgattatcaaaaagagctgacgggctatcccgatacagctgctatcgacgaaaagcttcaagacgtgaaaacgcagttggccaagctgcatgagcaggaacagacgctttacggacggctcaaggagaccgaatccgaagtcagccgtttaagaggacagactaaagggtgtgagctcgctttgcgcgaagcggaagcaaggcttgcgaaagcggcggacatctggcaggaaaaagccggaggcacaccgttcgaaaaggcctctgaagtgaaagcgagcattttggaccgcgatgagctttcccggctgaaagaagacattcaactgtattgggatcacacaaagcagtgcgagtccaatatcaagcgaattacggaaaagcttgacggcagatctgtttctgaagagaattgggaaaaagccgcagtcacgaaggaccaggcggaggaggcattcagcaaagctctagaggaaaggggagcggccggcaaagctctcgccgtcatccgcgagaaccataaaaggtttaaggagcttgaaacatcgttggctgaatggcagacatacatcgaccgccttgataagctccaagccgtctttaaaggaaacagctttgttgaatacttggcagaagagcagcttgaaagcgtcacaagagacgcatctgcaagactcggagaactgacaaggcagcggtatgcaattgaagtcgactcagaaggcggctttgtgatgagggacgatgccaacggcggagtcaagcgccctgttacgagtctgtcaggcggggagacatttctgacttcgcttgcgctggcgcttgcactctcggcgcagattcagcttcgcggagagtatccgctccaattcttctttttggacgaaggatttggcacgctggatcaggatttgctggatacggtcgtgactgcattggagaagcttcagtctgacaatctgtcggtcggtgtgatcagccacgttcaggaacttcgggccaggctgccgaagaagctgattgtccatccggctgaaccgagcggcaaaggcacagctgtatcgcttgaaatgatttaacctggtaaccaaaaagcagccttcttctagtggaagaggctgctttatgcatttccgacaacattctggtcgcttacatccgggtctatataatttgtcgcgtttataccattgttgacgataaggaaatctccagtattaccagcaccagaaccgagtgcagactttgaagagctttttggagatagataaaaagaatcgccgaaattcactactcctcctgagatttcattgattttaatgggtccgacaatggctggcatgattgatcgacatcctttatagaagtctctgaaccagtatatgtcggccgggcggttattgtgagttccttgcaggaggaagctttctgatatgtttgactctcgcctcggaaatcatgcggcgcgtcgaaccaacctgaaaaactgaagaagaagataccccggcaatttttacagctctgactcgaatgacgggaacctcatggaaaaaagctgatgagacgccggtttccggtaataaatgtggtatcggctgctgaaagagagggaaatcttcctgattaaatgagccttcatttccgaaaaaaagtgaaaggtagcgctgaacagcgagaattttcactttaggaataatctcttcgacatccccgatttgcagcgtgctggtgatccctactgaatgaactttcataaactttacttttgacgttctgatcatcttgattccggcgccagcgggacaaacggcccgacaatgagagattcaggcggtgtatcaaaaattgatgacagggaaatgcattctgtatctccgattaaaaaaacagatgagcttgaaactgcggtaatattaatattgcctacatcgaaacagcggttcacaacggtaaaattcattcgttttcatttcctttcatttcgtcaggaatcgatttgagaaagtgttcgattgcccgcgcgatatcacgcttcacataatcggccagccgttctgcatgctcgcgggactggatgttttcgtcaggctgcacatgtttgacgtaatagcggatgcggctgtcgatttgctttctgatgtcttcgatgatatggtggcggtttgtatcgtccagtttactgtcataccggtcttccagctgttccagcaaacgaggggtctcttcgtttaaataggcatcgacaagctgtctcgtttgctgcatcagctggctgtcaagctcctgctgaagcattccgatacccggcggctgttggctgatttcaaagttttcgacattatccgggtccgcaggattgagtccgatatttagcgttccgtccaagcgttcaatttttagttgatcaaatttgtattcgatccggtcgatccgggtgccgggattttctttcagctggttcaactccgaatgcaatacggcaatctgactttcgagcctctggatttgcgcagcctgctgctgcaaatacacataccagttctgtggattgctttgtttcatgagattacacccccgtatatctatggtactgtaacagaaggagcgtgaagaggaacgagagtcggttgagtcccatctccaaaagcgtcgtcaaagacttcgccggttaccggaggtgcgggttctgtgtagcttccggtattgtacaggttggcaagtgttttgattgaaccggcgcttccaatctgcaatacggaagagttgctgattccttcaactcttaaataattgatttgtattgtttgattgatataaaagttcatgccttcactccctacaggttgcctgcgaccggctgatcgattacatcgttgtcatatgtgttggtgatgctgttctggttgtatactctgagtccgtctccggtattgaagctgccggcacccgcaaatgttttaacttctgcataaggagaaatcgtgatgcagtctccgacatgaacaacgccgctcgtaccgacggcatttactttaaaagctccgacaatagctggcatgatggcacaccctttaattgatcaaacatttttttatgggctatacaccatatcctatgttgattaggcgcttttgtgattaaaaatgaggttcttccgtgagtgcagatcacatactggtgaaactaataagatgagaaaacgtatgaagaaggaaaacgtgcgataaggggagagacgtatgtattttcaattgaatccgatatcaatcgctgcagccctgctgttctttgcggccgcatatgcagtcggaataaaaaagcaaacctggatattgcgggggtttcgccgggaaagggtaagggatcaggataagctggcgaaaatcgctgggtatttctttttgaacagcggatttttgttatttttaaatggggttgtttacatcccgtatcaagagtcttttacaccttcagccattcttgcctactgtatttgcacgatgatttatgttcaaaaaacaatggccgaatagcccaagctgcgacccgaaatcaacggatgatgaaatggaggaggaaggaggccggcatcaggcgcagcttgcagtcggaggtcatgacgtgtggcggccttttctttcttccgcatgcacgcagttatcatccttttgcattctttgattcagcaagttgtccaattcctgactgcatcgaatggcctctttggagttgatgccgaacttttcggcagcttcaaataaggccagtctttttgcttcaattttattgttcatcatggcagtctccaactttcgatttgtattttgagtcggtaatttcaggtattcagcgcattgatgtccttgatattgctagtataccttattttgtgtaaaagggatttttttcgccaatatgacaaaaaatgtgacatttttttcggaggacagcgacagtctattatcgggaaagctcgaaaagcaggaaccgcttcctctgatcgatgaaatgaaaaatttgtttttgctcatcttcgagccggctgtatgtgacggttgtataaggatcatgttcaagaaaaggcgcgattgtctcgtgccagtttaccgcataccgcgaaagccggctgattgtaaattggcggtgcaagacatttttcattaaattaaagtattgggattgaaaagccgggatgtcgagcagccttgcagacagcgtattatagcctttcgccggaatccggttgtgctccatttcttccccgtgaatattccgtccccatgtcgcgtcataatcccatggaatgatttgaaacgtttttgtgcgaccgtttaaataaagcgcgtaattatggacaaagccgtcgaaattttgggtgtagacggcgccgatgagccacagcaaatattgtttgacatcgagatagcgtttgatttctttttcaaatatgtcgtctttggcggtattgataaagtagataaactcctggaggtagtcatcgtggcggcttgaacccgtttttctttcgtatccctgcatgagattttgcttagcctttttattgaaggaactcagcagagaaaaattagcatcgtcatcaacggcataataaatggcccccctttctaaatttctcctctttaagaaatgatcgtcaacagattcgatttttaaatagatgccttcttttttttcattgatataaaggaaaacgtgtgatgctgctggcgcaaggacgccgatttgttcaaaaaaatgaaaggaaagcctgtttctgatgaaagacggatcatgatattccgcgttcaaatgaaacgcagccttttctttattgtccggatattgaatgaaataggattttttcgtcagtttgcgggtgtgggcccctctgtatgacactgcgacaggcgtctttgctgaaccggtcaagagcatgccgggaacggcttcatcactccagacgtcttttttcaactcaagcagatgcttcggatgaatgtgcagcctaaaggccggcaaggcagtggcactcatcatcatttcctcctttttcagctgacatatcatatgtgaaaaaaacctgtcccggaagcagaccgcctaagtttgaacaaaaacagtcatttgcctcagtacacttgtctttacggcgcgtatgataaatcaggacataaaaaaggaagaacaggaggttacaagatgagtggtgtccatgatcatgacattaaaaaggcagtagaccagctgaagagcgaaggcagagaccattatttagaccgggaacccgaagaatacgccggctcgggaaaagagcggcgtccgcataacatttgggatctttggtggggaataaagccggacagaagcaaaaaacatcataaaagcaagaagcatgacgactatgaaaagccggataaaagcaaaaagcccgacaaaagcaagaaacccgatgactgcaaaaagcctgacaaaagcaagaaaccagacgactgtaagaagcctgacaaaagcaaaaaacatcacgactgcaaaaaacgcgacaaatgcggccgcaaacgccccgaccatcatcgctgcaagaagactcaccatcataaaagaggcggctatgaaaccattacaaaatggtctgacggaaatctgaccgaggtcatctaccggaaaaaataagaaaagcggcttgctgcatggtgagccgccattttcttttccgggaaggaacgcccgggactttagaagcggttttctgaaagaggaaaggaattttcgtttttttagagaatatgtagaatagctttaaatcatactgcgggggaatatttatgaagtttgcgacagcaaagctgcacagccgtacatttgtagggcttgtcatggatgagaagataatggatttgcaaaaggcggaaaaaaagctgtttgagcttgaaacgatacctgaaacgcttatcgaatgcgtaagcgagggagagaagtttgtccgccatgtcgaacagctagtggaatggtcaaagaagaaaaacagcgaagagagcggttcgtatatttatccgctgtcagacgtcgatttgcttgcaccgattcccgaaccgcggaaaaatgtgatctgcatcggaaaaaattatcgggatcatgcgattgaaatgggaagtgaagcagatattcccgaacatatcatggtgtttacaaaagcgccgacttcggtcatcggccacatggaagggattgatgcccacgaaggcgtgacagaggcgctcgattatgaaggcgagctcgcggttgtcatcggcaaaacgggaaaaaacatcccgaaagctgaagcgctcgactatgtgttcggctatacgatcattaacgatgtgacggcgcgcgatctgcaaaagaggcacaagcagttttttatcggcaaaagccttgatgcgacctgcccgatggggccgtttcttgtacataaatcaatgattgaagaccccggtgacctgaaggtggagacgagagtgaacggcgaactccgccagtcggggagcacaaaggacatgatttttccgattgcggaaatgatcgaaacgctgtccaaaggaatgacgcttgaagcgggggatattatcgcaaccggtacgccgtcaggagtcggcaaaggctttaatccgccgaagttcctccgaaaaggcgatcaggtcgacattacgatcgaaccgatcggaacgctttccaatccagttaaataaaggattgtcaaaaggatggctttagcatataatgaagctgtcaaattttttagaaatgagggatgtgtgatgagaatggatattgtcttttttgcccaacaaacgatcattgcacagcccatgtaatatttcgactggtattcttcaaatggatctggtgatatttccatgggctgtgaaccggctcatggagtgtttatatgttgaaagagccgtgtatttgcggctctttttttaatcaatcatcagatctttaggaggaaaccgaattgaatttatcagcattaggcatcaaatatatcatggaagctttaaaggatgaggaaggtctggttttgggaaggatcgcccttgagcataaaaggttgtaccgggtatggacggaagaaggtcagtggcttgccgaaatctccggcaggctgcggtttgaagtggaaagccgcggagactaccccgctgtcggcgattgggtgtatatgcgcccacgcggcggcgaaaagaagggaatcatcacggaggtcgttccccgattcagcaaattttcgcgcaaagcggcgggtgagccggcggaggaacagatcaccgcagcaaacgtcaatacgatctttctcgtcaatgcgctcggtctggattttaatgtgagaagaatcgaacgctacttgctgctggcatgggaaagcggagccaatcccgtcatcgtcttaagcaaagcggacattgctgaccggattgaagaaaaggtgcgccaggcggagtccgtggcattcggggtgccgattcacgtcatcagcgctcatgaaggcagtgggatggatgagctgaaagcgtatgtgaaacaaggggaaaccgtcgcccttttagggtcgtcaggcgtcggaaaatcaacgatcatcaacttttttctgaaggaagacaggcaagccgtccaatccgttcgtgaagatgatgacaaagggcggcatacgacgacgcacagggagatgtttatgctgcctgaaggcgggcttttaatcgatacgccggggatgcgggccttagagctttgggaatcggaagaaggattcagacagagcttcagcgatattgaccagcttgcaaaaaactgccgattttcagactgcatgcatcaaacagaacccggctgctccgtgcaggaggcgctggctgacggcagactcgatgccggccggttccaaagctacctgaaattaaaaaaagagctcgaatacctcgaaagaaaaacggataaacgggcggcgcagcaggaaaaaaagcggtggaaacagataacgaaaagcatgaaaaagaacaaaaacaaataaatgaaaaaggcgctgataaatggcttcagcgtctttttgctgcggaaatgacagcgttcacattgttttgtttaatggaccggttcatgataagataagaacgatacctgatttgatagggggaaaaatgaatatgacgcatatgcatatcacgtcttgggtgatcgcgctcattttagtgttcgttgcttacggactttactcatctggaaacagcaaaggcgcaaaaattacacatatgattctccgcttattctatattatcgttatcattaccggggcgcagctctttttaaagttcacggcatggaacggagaatacatagcgaaggccttgctcggcctcatcaccatcggattcatggaaatgctattaatccgcaggaaaaacggaaaagcggccactgggatctggatcggctttattgtcgttctgctcttgacggttgtgcttggactccggcttccgctgggctttaaagtgttttaattaaatgacatcggttctttatgaggactggtgtcttttttatgtcggcggcttgaatgttgaaatcataacgattcgttccccatctgaagcggtccattcaaatctgtccttccactcctcttttctttcgtaatgatgctgcagggcgcattgtttcatatcatgagaaaactgataaaacgaaacgcccttgacatcctttttctcgggccaaaagctcaggccgttataggcgaagacgcagtcaaagacggaaaagccgaggctgttcagctgatccaaaaaagaatagaactgtccgtcttccagatcgttcaaaaattcgagaaatgcctgttttaccgttttcagataacggatcggttctcctcctgtcagcttcacggtctccggtttttccgttacggcgaattgatcaaacagttcggctttttgccattctccgtctatgctgatgaaaactccggggctgttcaggctttcaaccaaaagcaaatctccttcttcattttcaatcaggcagatcccgtcttccattaaaattttgccgtaaatccatttgcgcttttcggcataaagtcgtttctggcgttcggtgtccatgggcggtctcctttcttatttcgttttttccaaaacgggcttgtctcatacaagactctgttggacaattcaactattattttaaggtgcataaaataggtaaagtgacaaaggaagtgaagcctaaagcagaggaagtacattagaattggagctgatcgacaatgtgtggaataacggggtgggtcgattttaagaagccgcttgtccgagagcagtcaatcatggagaagatgactgatacgctttcgaaaagaggacctgatgatacgaatatttggggaaagcgccatgttttattcggacataaacgcttggcagttgtggatctggaaggcggcagacagccgatgacccgcacacatcaaggatatgattatacgatttgctataatggcgagctctataatacggaggatttgcgaaaagagcttaggcggcgggggcatcaattcaagagccactcagatacagaggttttgcttcattcatacatggaatggaaagaggaatgcatcgacaggctgaacggaatttttgcatttgcggtatgggatgaaaagcgggatcttctttttgcggcacgcgaccggcttggtgttaaaccgttcttttacaccgaacagggctcatcatttttgttcggatctgaaatcaaagccatcctcgctcatcctgaagtgaaagcaaaggtagaccgttcagggctggcagaaattttcggcctcggcccgtcacgatcgccggggagcggtgtttttaaaggagtaaaggagatccgcccggggcatgcgatgattttctcaaaagacggtttaacggtttggcgctactggaatgtgaaaagcgagaagcatacggacagctttgacgaaacggtggaaaatgtgcggtcgctgtttcaggacgccgttacaaggcagcttgtgtctgatgtgccggtatgtacgtttttatctggaggggtcgattcgagcgccattaccgcaacggccgccaagcatttcgagagagaagggaaggcgccccttcatacgttttcgatcgattatgaagacaatgagcaatattttacgtcaagctcatttcagccaaacgccgacggcccgtggattaaaaaaatgtccgatgcattcggaacggttcatcacaattgcgtgatatcccaggaggagctggctgcctatttggaagaagccgtactggttcgggatttgccggggatggctgatgtcgattcttccctgctatggttctgccgcgagattaaaaaagactttgtcgtgagcctttcaggggaatgcgcggacgaaattttcggcggctatccttggttccattcggcagaagatgtgaaaggtttcccatggatgagatcaatggaagaacggatcgcacttctgcaggacggctggcagaaaaagctgaacctcagcgaatatgtgaaggcaaaatatgaggaaacagttaaagaaacaccgctgctggaaggagaaacgggtgcggagaaacgaaggagagagctgttttacttaaatatgctctggtttatgacaacgctcttggatcgaaaagacagaatgagcatgggtgcgagcctcgaggtcagggttccgtttgcagatcacaggcttgtcgagtatgtctggaatattccatgggatgtcaaaatgcatggcagccgtgaaaaaggcatcttccgcaaggcgctggaaggcattttgcctgatgaagtgctgtaccgcaaaaaaagcccatatccgaaaacgcaccacccggcctatacgaaagccgtgatacgctggctggagtcattgctggagcaaaaagactcggcgctctatgctttcttagaaaagaaaaaactggagcggctgattgagacggaaggtgcatcatttcaagttccgtggtacggacaattgatgaagggaccgcagctgatcgcccaccttgcccaaatccatacttggtttgaaagttatcgaattgatatcgaggaataacataaaacacccggcatatgccgggtgttctgcgttttggcagctaagctataaagaaacggcggcgtttattttgaacaccgccgatttctatgatcagcaagccggcctgagagccggatgcatgagagtcacacctgttcagttttggaagaaggtccaggctttaaattgttgagccgtgagacaagatccgttccgaaagcggagcttacgtcaacatcgtcctgatcgatgtagctttctttatactcgtacgcggaagaaccgtgttcggcataatctagtccggaaatttcctcctcttttgataccctgatcggagcgagggctttcattgccgcggcgacagcgtatgtggcagcgagggtccaggccgcgatcgacaaaatgccgacggcttgaatgccaagctgtgcggctcctcctccgtaaaagagaccgctcgatgtattgaaaagcccgactgcaagcgtcccccaaacaccgcaaataccgtgaacggcaagggcgccgacgggatcgtcaagcttcagcacctggtcgataaactgaacgccgacaactaaaatgacaccggcgatgaatccgatcaatatcgagcctgtaaatgaaacgccgtccgcgcccgcggtaattccgacaaggccgcctagcgcgccgttcagcgtcagggaaggatcgatcctgccgtagcggaaataagtgaacagcgccgagctgacgactccgcccgatgccgctaaaagggttgtggtgatgacgtgcgggacggcggcgggatcagccgcaagcgtgcttccgccgttgaacccaaaccagccgaaccacaggataaagacgccgagagcgcccagcggaatgctgtgccctggaatggcgttgaccttgccgtttgtatattttccgatccgcggcccgagaaacatgacagccgcaactgcgcccgcagcgcctgtcaagtgaacgattgaagatccggcaaaatcgacaaatccgaggtcgtacagccagccttccccccaagtccaatggccgacaaccggatagatgagaccggtcataaacagcgtcaagatcatgtagctgccaagcttcatccgttcagcgacagcgccggaaataatggtggcgcacgtagcggcaaacacggcctgaaagacgaaaaatccgacatcctgatcacccgctagagcaaaaccgcttgtgccgatgaacccgccggcgctgtccccgaacatgaacgcgtatccggcgaagaaataaaggatggagccgatagagatcgtcaggaagtttttcattaaaatgtttaacgtgtttttagctcttgtaaagcctgattcaaccatcgcaaaaccggcgtgcataaaaaagacgagcagagtgccgatggctacccatgtcatgttgaccgagtcattgaccgattgcaccgtcggttcggcggccagagctgatgctgcgaggaaaaaactgaggaacaggacggcagataccttggttttcataagaatcaccctttcttaaagtatcgactaaaagagagcaggagggaatcggtcgttttagacaatcgcttcctttcctgattcccctgtccggattcggatcgcgttttcaattggaaggacaaagatttttccgtcgccgaccgtatttgtcgaacatgtgctttcgatttgataatttcatcaacgctctccgattcaatcaccatttcgactttcactttaggcagcagcttgatttcgtaggaggtgccgcgaaacagagcctgcttcccccgctgctggccgcagccggcaacctctgagacggttaatccgtttatgccaacctcttcaagctttttgcggaggcgggggaactgttcggggcgtataatcgtttcgatttttttcacaatgcaaatcctccttttggtgtaaggttatattacgtttgttgttatgtttcttatcatacgtaaaagtaaattgaaaatcaatacgaattttcaaaaaaattaatctattagacctattctttgagaggtctgtgttcatagaatggcagtctcgttaagttttataacatgaaaaaacctgctttcaactgaaagcaggttatgctgcaaatcctttttgaagccacattttagatctccatcttctgtacattaaaattcccctgacccattcgtcggcgatgaaggaaaaccaaattcccgccaggccgaatccgagctgaatgccgaaaatgtaagcgatcggaagtccgattccccacatcgagacaatcgccatataaaccggatatttcgcgtctcccgcagctctgagagaattaatgatgaccacgttaaacgagcggccgggctccaagataatcgtcaaaaggatcagtatactggccgttgcgataatatcgggattgctgctgaaaatgccgatcagctgttttgaaaacacagcgaagagaacggaagtaaatgttgtaatggccagagcccaccacaggcttttcaggcagcggctgtatgcttcatcaaattgcttcgcgccgatatggcgtccgattaagatttgcgttccctggctgatcgctgtgccgaaaagcatgataaacatcatcaaattttgggtatagacttttgttgtcagcgcctgcgcgcccatcagcgtgataaaataggtgacaatcatctgtgacgcgttatatgacagctgctcccctgctgaaggaatcccgattttcagcagttttttcaggtgacttttctttaagacaaacagccgtttggacaacagcggcatgccgacgcgctttttgacgagcagagcgatcgccaaaaggccgatgatgcgcgcgattgaagtggacattgccacgccggccacgcctaaaaccggaaagccgaacggtccgaatatgacaagatagttgccggcgatgttcaggatattcatgccgatggttacaaccattgtgtcctttgtatacccgtagcttttcaaaatggcgctgaacgtcataatgagcgcttggacaaaggacagtccgccgacgatctggagaaagatgccggcttcagcaagcaggttggcggaaaggcccatcatcaataaaagcggtttggcaaatatataaatcgccgcactgatgaatagactgatgataaaattggcgctgatggaaacatagccgacttccattgcttcggctttttgccgcgcccctaaaaattgagaaataatgacggttgttcctgttgcgataaaaccgaacatcacaatgatcaagttcagcatttggttgctgacgccgacggctgccacgctgtcgtcggaatattggctgagcatcagggtatctgcgttgcccattaacatatataatgaaacctcgataaagataggccaagtcaatgcgaataaagagaggttttgaggtgctgtttttttcatggcgtttgacccctttcttttaaaattccgttttatagtgtaacgccattttcttataataagaagagacgaaaccgatacttcttggagaaatccgacttgatgaaaaaggggagagaacatggaacatatcatctttacaattccgccgctccctgtgttgattaccggcggagaagggctgttcaaaagaggggaaaagcatgtgaggcgtgaatattccgtgtttgatctcttatatgtgatacagggggaactatttttgactgaggacggcgagccccatcagatccgggaaggggaatacatcatccttattccggggctcgagcattatggccaccgcggctgtcaagacgatacccgctatttttggctgcactttcaggagccgtcctatggcttcgcgcagcagggaggtgagaactggactgaactcaagctgaggaaggggacatttgaaacgccgacattgtatcatttaaagattccgagaaagggaaagatcgaccaaaaagcgtttatcgaacagcagtttaggcgtttgattgacgattccgcccaaaattccgacctgccgcttcgcaggcagctcttgttcgaagagctgctgattcacttgcagaaggaggcgttccatattccttcggcgagtgagcgtgtagcatccgaagcacagcattacatcgaccgccattataaggagaagctcagcatggagcagctctcggctgcccttcattatcaccaggactacattacccgctgcatgcaaaaggtgtttggcatcacaccgggccaatatgccaataaggcgaaagtttttgaagcgaagcggctcctctcttctacaaacgacaaaatgtcatcgattgccgaacaagtcggaatcgatgatccgacctatttctcaaagctgtttaaacaaatagaagggatttcgcccgttgaatacagaaagatgatgaagcgaaatattgagtgatattttcaaagcataggaggagataagtttggcatccatcaatggtgaaaaagtgaaattgcgtacgatcacaatggatgacctgcccggattatggagaatgatttacggaactaaaaaccctgaatggaaaaaatgggatgccccttattttccgcttcagcccgaaccgtttcaatactttatcgattcttttgtgccggctttaaaagaaaaaccgccgcgctatttggcgatagagatcggcggagagctgaaaggaaccgtttcttactattgggaatcccggccgacacgctggctggaatgcgggatcggcatctatgatccgcggttttggaacgggggatacggtacggaagccgtagaattatggatcggcttcctgtttgaaaacgtcgatgtgccgagaatcggaatgacgacgtggtcaggcaacaggcggatgatgaggtgcgccgaaaaagccggatttaagatggaaggccggattcgcaaagtcagatattatgacggagtctattacgattcaatcagatacggaatcctgcgggaggagtgggagctgatttgccgcggaagctgacacgctctataatataatattagaaatctttcatcagcggactagaggggaccaatatgaaaaaaaccatttatgatgtagcggaagcggccggcgtttcgatttccacggtttcccgggtgatcaacaataccgggaggatcagcaggtcgacaaggcaaagagtgcatgccgtcatgaaagagctcgattaccagccgaatgttcacgcttctgcgcttaccggaaagcgcacgaacattatcggcctgttgacgcccgatattgcaaacccgtttttcggcgagcttgccaaaagtgttgaagagcgggcgggcgagctcggcttcagcattatgatgtgcagtaccgaccgcgatccgaaaaaggagacaacgtatttctcggtcctcaagcaaaaaagcgtcgacggcatcatttttgcgacaggcatcgaaaatcaggagacgatggatgcgctcgaggatattgccaaagagggcataccgctcgtgatgatttcccaggatcgcgcccttgttccgatggatgtcgtggtcatcgatgattttatgggcggatatttagcgacgcggcatttaatttcgctcggtcataagacaatcgcctgcatcgccggcgacggatcgacaaccggagaaaaagacaggctgaaaggcttcaaaaaagcgatggatgaagcaggcatcaaagcggatgaaacgctcatcgccggatccggtttttccctggaatgcggcaaaaaagcggccgctcagattttcaaaagcaatattccgaccgccgtttttgccatgaatgatgtgctcgcgtgcggagtcattcagactgcaagggaatgggggctccatgttccaacggatttatcggtcatcggctttgataatacgtttttagccgaaatgaccgatccgccgcttacgacagtgtctcagccgattgaagaaatgggccgccgcgcggccgagctgcttgccgaagaaatcagcggcaagaaaagctcgaaaagcaaaatcattctcacgcctgaacttgtcgtcagacagtcgacggcccctccatttaaaaaagaagcacatgccgaaaagagcgggttttgatagaaaaacgctcttttttcgtttctaaagagcaagcgcttgaccaaattaattcctaaaaaacaattgcggataaaataaatacagggtaaaatcagaattgaaatgagcaagcgctttctctaattaataaagcgctttcatgaaacgcaaaggaggagaagaaaatgacagaagttgtgagatgcgccgtattggggcttggaaggctcggctattaccatgcgaaaaacctcaaaaccgaggtgcccggagtcctgctcgccgctgtagccgatccggcagagggaagtgcgagggaggttgcagctgaactgggtgttgaaaagtggtttgaagacccgtttgagtgcctccgcgatccggaaattgatgccgttgtcatcgttacaccgacatccactcatgccgaaatgatcaaacaggcagccgaattcggcaaacagatttttgtggagaagccgctgacattaaatcttgaagagtcaatagaagtcatttccaaggtcaaagaaatgggcgtgatttgccaggtggggtttatgaggcggtttgatcctgcttatgcggatgccaaaagaaggatcgatgccggagagatcggcaaaccgatctattataaagggtttacgcgcgattttggctctcctccggccgaattcatcaaaaaaagcggcggtattttcgtcgattgttcgattcatgactatgacatcgctcgttatttaatgggggctgaaatcactgcggtttccggccacggaagggttttgaagcacgcattcatgccgggatgccatgacgtcgatcaggcgctcacctatatggagtttgattcgggagcggcgggtgatgcggaagcaagccgcaattcgtcttacggccacgatatccgcgccgaaatcatcggaacggacggcagcatcttcatcgggatgctgcggaacccggcggttacagtgcggaccggaaaggggagcagctataatatcattcccgatttccaggcgaggttccatgaagcgtactgtttggagctgcagcattttgctgattgtgttcgcatcaaaacgaaaccgcttgtgactgaagtggatgcggcggtcaatcttgaaatcgcgcttgcggccacacaatcctggtcaacaggcaggcccgtcaagattcagtatcagacgaaaaagcttacggtatgaaacgggggccaccctgagcgggctgttgagatgatcctgcggtcacaaaggaacaacaggaaggagggcgtaaggaagcgttccccgcccggtgccgcctttctccatgcgttttcaattttgcgggcttcccatggatgccggaggattagacccgtccgtcattccggcggtaaaaaaacggcatggcgccgatttgttgtacacgattccgtcatttcacaatccgacgggcaaactgatgtccgaagaccggaagcgcgagctgattcaaatcagcaagcagctgtcgctcccggttattgaagatgacgcatatggcgatttgcagcttgacggcccgccgtcgtcgccgctgaaggccatggacagagaaggcagcattctttatgtcggcacattatcgaaaaccgtcagtcccggcctccgcatcggctgggtcgcaggtccggagcccgtcatcgagaggctggccgatattaaaatgcagactgactacggatcaagttcattgtcgcaatgggcggctgcaaagtggctttcaagcgggctctatgatgaaaatctcagccggattaaagtcgaactgagacaaaggcgggatgaagcgctccggtgtcttgagacctattgcagaggaatcgcccgctgggaaaagccctcaggcggattttacatttgggtcacattcctaaaaccgctctcgctcagcgctttgttcgaacaagcattacagaaaaacatcctcatcaatcccggcaccctctacgataaggaagccaaatacagcatcagattgtcctattcgtacgcctctttgacagagcttcgctacggcattcaaacaatcgcagaactcgccggtaagctcatgtgaaccccgctgtaccggctgctgaaaaagcgacgttcagcagccgctccgctttttatttcaggcctcaggttatttaaaaacagtccataaaattccattaatatatcattcaaggaactattgattcatattagcagatgaatgtgcagaagtggaaatattcaagttgcctcgttatgagaaacgtcctatttttctgaatcttattgacatgccggtgtcacaaaatatacactttttttgtaattgaaaatgataatctttatcaattggagggatgctttctatgcctgtacaaacgagttctaaaaatcaagtgtttttggagcagcaaaatagaagagaatctaatgcgcgttcatatccgagaagatttccgctcgccatgcagacagcggaaggcgtcttggtgactgatgcggatggaaagcaatattatgactgtctggcaggagcggggacgcttgcgcttggtcataatcatccagttgtgattgaagcgattcaaaaaatgattgaggaaaaacgcccgctgcacacccttgatattacttcggaaatcaaagaggagtttgtcaacgaagtatttgcaagccttcctgaggcgtttgccaaacgggcgaagatacagttttgcggtccgaccggcggcgatgcgatcgaagccgctctcaagcttgtcaaaacggcgactgggaaaagaaccatcctatcgtttcacggcgcctaccatggagcaactcacggaacgatggcgctgagcgggaatttatctcctaaggaaaacgtccagggtctcatgcctgatgtgcatttcctgccatatccgtatgaataccgctgcccgtttggaaaaggaggagaggcgagccacaagctgtcgagcgcatatatcgaaaatatgctggatgatccggaaagcggagttttacagcctgcagggatgatctttgaagccgtacaaggagaaggaggctcagttccggcccgggctgaatggataagagaaatgagaaggattacaaaagaacgcggaatccctctgatcattgacgaggtgcagaccggcatcggcagaaccggcaaaatgtttgcgttcgagcacgccggcattataccggatgtcatcgtcctttcaaaagcgatcggcggaagccttcctctgtctgtcgtcatctatgatcaagaccttgatcagtggggacccggggcgcacatcggcacattcagagggaatcagatggcgatggcggccggaagtgcaactttaaaatatataaaagagcacgatgtgctatcacatgtagaaaaggtcggagcgaagctcatgcgggaattgcaagacattcaggagcacgttcccgaaatcggcgatgtccggggacgagggctgatgatcggcgccgaaattgtcgcaccgcataaaaagcaaaacgcaaacggcagctatccggctgatgcggagcttgcaagcacgattcaaagaaaatgctttgaaaaaggactgatcgttgaaacgggaggccgccacggaagcgtgatccgcttcttgccgccgcttatcgtaacagaggcgcaaatcgacgatatcatcacgatcttcagagaggccgtctatgaagcagtcaagtaaacaaaaaaactttgattccctgtttatgcacaacggggaacaggggatcaaagcataccgtgacgcggtagagaccgctgtagagacgctttgggccgattggaagaataaatcgaagccctacagcgggaagatgccgaaagaattggatctcgaaatcaaaagcttgttttcgtttcaggaagcgggagaatcgcttgcggatgttcttgagcatctgaaagaagcctatttgccgcaccggattcatgttgaagatccaaaatgcgccgcacacctgcactgtccgccgctgatcccggcgcttgctgcagagatgctgatcagcgtgctgaatcagtcgatggattcgtttgatcaaagcggagcggcttcattgatcgaggaagaaatggtgcagtggctttgccgaaagtttgaatacggaaaagatgctgacggaacatttacgagcggagggacacagtctaattacatggggcttcttttggcccgcgatgccttctgcgaaaagcagtggaactggaatgtacagaaggacggactgccgccggaagcgaacaggctgcggatcctctgttcaaaggatgctcattttaccgtgaaaaagtcggcttcccagctcggcctcggagagcgcgccgtcgtgcttgtcgataccgatgctgaaaagcggatgagcctttacgatttaaagcaaaaaaccgctatgctgaaggaatcgggcttacatccatttgcgattgtcgcaacatgcggaacgacggacttcggaagcatcgatccgctttccgagcttgcggatgccgcgcatgctggcgggctttggttccacgttgatgccgcatatggcggagcgttgattttgagcaggacccgccgctataaattggctgggatcgacagggccgattcaatcagcgtcgacttccacaagcagttttatcagccggtcagctgcggcgcttttcttgtaaaagacagaagacatttccgcttgattgattatcatgccgattatttaaatcctgaggaggatgaagcggagggaatcgttcatctcgtcaataaatcgattcagacgacgcggcgctttgacgccttaaagctgtttgtctcgctgcgtgtgcttggagaagatacattcgccgagatgatcgactggacattcgcattggctgaagcggcagcggaaaaaatctcagcaagcgatcggttcgaactgctgaatccgcaccctgaactgaacgctgtcgtcttccgctgcctcgcctcagaagacgacgcggagaacgaccgtttgaataaatgtatccacagagaattgttcagaacgggacaggcggtgatcgcaaagacggcagcagctgggaaaacatatttaaaattcacgctgctgaatccgcggacgacgctttcggatcttgatgacattctcgggaggattcaagagcttgcaagtctttatacgaatagcaggagggtaacaggatgagttcatttaaagaaatagcagaaaacgccacgattcaaagctttttaaattgctatttgcgtgaaaccggcatcgaaacccgtgagatcgcggacggctctcaaaaaacgctgattgtcccgctagagcgccagcagatcgagctgatcgttccgatcaagtactggtcgaagacgggaaggcaccttttctcatttccgctttattatcaaacagcccaaaacggaaagccgcttccactcgactatgtgacgctcgtctccctcgcttcaaaggaattgcttcttcagcaaagccgcgggggtgccgaggatgaattcatgctcagagtcattttgagctgccgaaatatcagccgttatgttgaggaacgagccgatgatcaaagtgagcttagccgtgctgattttacgtttatcgaagcggagcagtcgctcttgctcggccatctgatgcatccgacgccaaaaagcaggcaggggatgaagcctgaagaggaaagcatctattcgcctgaacttaaaggggagtttcagcttcattactttaaggcacacgcctccctcgttctgcacgactcaagtacaggaacaaaagcgccgctagtcattcaagaggaattgagaaacgacccgatgattgacaatgcgtggctggatgagcaaacggccgatccggattttgcgcttcttcccgcacatccgctccaggcgagagccttgttggaggagccgtatgtgcaaaaattgatcgctcaaggtctccttacatatctcggcgcaaaaggccggaagtatacggcgacatcctccgtccgcacggtctacagcaagcactcgcgctatatgtacaaattttcggtaccgatcaaaatcacgaattcgctgcgtgtgaacaagcagaaagaattggacagaggtgttgaaatggcccggctgcttcagacagagctcggccaaaggttgaaacaggagtttccgggctttcgcgtcatcacagatcctgcttacatttccattcgaggagagaacggggagtccggctttgaagtcgtgatcagggagaatccgttttatgaagacgaccgttcggcatgtctgatcgccgggctttgccaagatcacgcctacgggaaagagtcgcggctgtgctctgtcatccgcgggctggctttagaagaagggcggacgacggaagaagtgagcatcgattggtttgacaaatacttatcgatttcgcttgagccagttttatggctgtttgaaacatacgggctggcgattgaagcgcaccagcaaaacgccgtcatccgcttaaaaaacggctatccggagacattttactacagggacaaccaaggctattattacagcgaatcaaaagccgggattctttccaagctgatcgaaggcttgagcgaaaggagcgagacgatctgctcggacagcgtggctgtagagagactgcgctattatttcttcttcaaccatttgtttgggcttgtaaacgggtttggctgcgaagggctgatcggggaagaaacgctcctgtccatgatcagagagcggcttgaaaaagcggagcaaatttacggtatcacagagctgacggacagcctccttcgttttgcggagcttccgtgcaaggccaatctgctgacgagattttacgacatggatgagctgacaggctcgcttgaaacccagtctcgctatacgtctgtcaacaatccgcttttaaaggaggcggcggctgtccaatgaatgaacggatcacatttcaaaaagcggactatgaaagagacatatcgctcgtctaccgctggatgcaggaggagcatgtcattccgttttggcatttaaacatgccgtttgcaaaatttgaagcccattttcacaaggccatcacagaccctcaccaaacgctgtacatcggctttatcgacggtgtgccgatgagctactgggagtcgtactgggtcaagggagacatcattgaacaccactatgacaatgaaccttttgaccagggcatccacctgttgatcggtgaaaaagcgcatttgggtaaaggtcttgcccttccgctattaaaagcgatggtcaacatgcaatttgccgtgcctgaaacaaaaaaggtgatcgcagagccggatatccgcaacaaaaaaatgattcatgtttttgaaaaatgcgggtttcgccctattaaacctgtgaatctccctgataaaaccggattattgatgttttgcgaacgagaacgtttttttgaaaaggagaaaaaagatgaactctacaaagagacccaatgatgtatacgatgtcatcggcgtcggcatcgggccgtttaatctcggccttgccgcattggctgactccgtgcctgagatcaatgcgctgttttttgaacgaaacgaaagctttaactggcatcccggcatgctgattgaaggaacgacactgcaggtgccgtttttggccgacttggtgagcatggccgatgtgacaagcaaatacagctttttaaactatcttcagcagcataaccgtctttattctttttattttctggaagactttcatattccgagacaggaatacaaccactactgccgctgggtggcagaacagctcgacccgtgccgcttcgggatgaatgtcgaaagcatatcactcgttgaatcgaacccggaggcgctttttaaggtgcgggtcgcgaatcgggagaacggaggggaagcggtttattacacgaggcatattgcgcttggcattgggacgggcccgcacgttcccgatgcgctctcagacgctttggggggctcggtgttccattcagccgagtatttaaagagaaagcccggcggatttaaagggaaaagggtggccgtcgtcggctccgggcaaagcgcagccgaagtgttttatgacctggtcggtgaagatgaagcggagcatgtcagctggctcacccgctcaaaaggcttcttcccaatggaatattcgaacctcggactcgaatatttttcgcctgactatatcgattttttctatcagcttccgcagtggaaaaaagatgaattgctaacgcagcaggatcttctttataaaggaatcagcgcgaagacgatcagcgatatttatcatattctgtatgagcggacctgcggggggcggaaagcggcttttgatcttcagtccatgacagaagtcgagcagatcgaacagcgtggggaaacgctggttctatactgcacaaaccgggtgaatgaagaccggtttgagcggcaggcagatgtggtcgttctggcgacgggctataaagagaggctgccggaatgtctggcgcctgttgacagtttgattgaaaaggacgcgagcggccgctacgtgattacacgcgactacagactagtgacagctgcaaaatcaaaaaaccatatttttattcaaaacggagagctgcacacgcacggtgtcggtgcacctgacctgggactcggcgcttaccggaactcggtgatcatcaatcagctggccgggagagaagtatacaccgtcagccataaaacggtttttcagacattcggaacaggaatcgcggaaaaaacagctgtaccaaacggctaataaaggaggcattttcatgttgtttcaagatgaattaaagagggtcctcgatcctgacaggtggagagaagtcaatcggcgattgctggcgaagatgctttctgaatatatgtatgaggatatcattaagcccgatttcattgaaactgaagacggcatcaaccgctatgagctgagaacggccgaggataaggtgtaccggtttgccgccaaaccacgcatgtttgacagttttgacgcggtgccggagacgattgaagtcttcaagggcggacaatggacaaaacatgtgagcgcgattgaatttctcctggatattcagccgcatatcccgatgagtccggagacagcgggtcatttgatcaaggagttcaaccatacgatgctggctgatgcccaccttttggcaaaggatgcgcttacggctgacgagctgaccgaagccgattatgccgtaattgaaggcgagatgaccggccatccgtggatcgtctacaacaaaggaagaatcggttttggctatgatgactacctccggtttgccccggaaaatcagagagccaaacggctgctgtggatcgctgtacacaaagataccgcgtcatttcactcggttgaagggctcgattatgagacgctgattcataaagagcttgatgagctgactttaaggcaattcgctaaagtcatagaaaagcagggcgcagccagtgaagactattattatatgcccgtccacgaatggcagtggacaaatacgatcattcagcagtttcctgaagaaattgcttcaaaagcgatcattcctttaggggaaggcggagacgagtacctgccgcagcaatcgattaggacctttacaaacatcacaaacaaacacaagcatcatattaaactgccgatgagcattttaaatacgcttgtatacagaggcctgccgtcggaacgtacggttatcgcgccgaaaatcactgagcatatcaaagggatcgccgaaaacgacgcatttctaaaagacgaatgccgggtgatcctgccaggcgaaaatgccagtctgaacgttgaccaccaatactatcactctcttgaaaaagccccgtatcaatatttggaaatgctcggcgctattttcagagaaagcatttatacgtatttggaagaaggagaacggcctgttacgctcgcttctttaacatacattgatcaaggcggcgtgccgtttatcaggcgcctgatcgaaaagtcggggctgtcagcggaggagtggatcggaaagctgtttgacaccgtgatgccgccgcttctgcatttcatgtaccgctacggaaccgtattttcaccgcacggacaaaatacgattctcgtcttaaaagatcatcagccgcacaggctggcgattaaagattttgttgatgacgtcaatatcagcgaccagccgcttcctgaactgagcggtttgacaggggatttaaaagccgttctcagaagcgagccgccggaagggcttgtgcagtttatctttaccgggcttttcatttgccatttgcgctatgtagccaacattttagaaaatgacggtctgcttcctgaaaagcgtctgtggaaagctctggctgatgcgattcttgattatcagcaaaaattccctgaactgcgtgagcgcttcgaattgttcgacttattcaagccggaattgacgaagctctgcctcaacagaaaccggatggtcgactacggctacaaggacggcgatgaccgcccgcacgcctccgaattcggaaaagtgacaaatgcgcttgcgaaatttaaaaaagaggccgcaaagctgtaatgctaatgcggccgagaatgccccgcttccggcggggtttttttacgtcaatttcttatacatcaaaatatgaggtccgatcggcggtatgtcgtagacttcgccctgttcgctgaagccgagcttttcatagtagccgctcacagatgtcctggcattgcaccataaaaggtctgccccctttttccgaagaagctcttcggcatggcggatgagcgtgcttcccgctttttgctcacggtatccttcaagcgtcgccatccctctcagctgatactgttcttcgccttcaagctctgaatgttcggctttatgaaaggaagcgatgctgatcagcttgccccggtaatatccaccgaggtgaaacgcacccccgagcaaatcggtttcatacatacatgcttcaagcggctgattcggccggagaatgcggtgcctgatctcatacgtatcttccgcgtttattggtttgacttcaatcatatgattcctccttcagttgcagatcagatgagagcgatcgattttcagcatgctgtgatgttattccattatatataacgcttgtggaaacaatcaaagcaggatgatcatcaccccctgatctgtttaaagaatcatttcccccgggaggcggtccctaatccctatatcgtaaatggcggaatatatcgtccatccacatcggtaaactgatattctttggctaaatcaccaactcttaacgcacgtccgcttttctccatcacatccggatccttagccaatgctgtgattccgcgtccgacataataaggcgtttcggttctccttaaatcttccgactcccgccaatgcgcctcatctgattcatggtatttcagcacaagttcggttctcataaatcccggcgaaacggcaataacggcaatgttgtcccgttttaattccaatgaaagaccgtacgccatgcggacgattgcgttcttggccaaatcgtaataaaactgtccggtgtacttgttctcatcccagaaggtcgtgtgaatgataagagcttgtttattttcgcgaaggagcggcacggcgaagtggtttgtcgccagctgggcacgcaccccggcggcgaacatcgtatcccaatttttcaatgacaattcccaaaaaggctttgcctcgacacccagatcgtgcgccccccacacattgttgatcaaaatatccagttttccttgctcttcgcgaattttagcgatgacagcctctgtttctgcatcgttcgtatgatcacatcttacagcaatagcctttccgccggaagcttcaatttgtgacacggtgtcatcaattgtaccgggccattgattcgtggaagcccctctgatgctgcggcctgtaatatacacggttgcaccggcttttccaagttctgcagcgatggcgcggcccgcgcctctgcttccgcctgttacgagggcgatttttcctttcagcggcttcattcatcccattcctttcatttaaaaagatatgttcattataaaagctcaatcttgacaaccattgtcatattttattaaataagttcattcattgataagaaaggtggtcatatgagaggggatcgactgatatctattcttttaatgcttcaggcacaagggcaaatgacggcgaaagaattagcggaaaggctggaagtctccgagcgcacgatttacagggatatggaagctttaagcggagcggggattcccgttgtggccgaacgcggcataaacggaggctggtcattgcttgatgattaccaaaccactctaaccggcttaaaagaatctgaaatacgcgcactatttgttccgctttctgaacaattgcttgacgatctcggattaacccgcatatccgaagaagcccgaaataaactgattgcctcgctgccttcggaatatcgccaaaacgcaaaggatgtatggaaccgcatatatattgatacctgttcatggcgccataagaaagaaaaagcagaatcctttgaagtgctgaaagatgccatatggaaagatcaaaaattaaaaattgtctatcagcgggcagatggacaaacggctgatcgtgttgttgcaccgcttgggctggtggctaaaggggcgaactggtatctgattgcatctaaagaaaatggggagattcggaattacagggcttcacggattaaatctgccgtttttgtccgcgaaacgtttgataggcccgaaaattttgatattgctcacgtgtggcggtcttcaacaaaggaatttattgaaaggctgccgacgtatgaagtgcgggtgaaggcggcgcaggccatcttgccgaggctgtcgtttaccaatcattttgtgcggatcatcgaaacaaatgagatcgatcaggagggctggatccccgttacgctatcctttgatacggaagaagaagcaaaaaggtatatactcggattcgcagagcacatgaggatcattgaacctaaagaactgcacggaaagatacttaaaatggctgaatccatagttgcgcattataaaacctgaaagcggcaatgactttatgttaaagacatacatgataaaccctgccggccgcaaacggcaggcagggtcttcgtttaatgaacattgaaatatctggcttccgggtgggagacaacgatcgctgatacggaagcttcgggctccatcatgaagccgtctgttaagtgaacgccgatgccttcgggctggatgagcctgaaaagcttttcctgatcttcaagattcggacaggccgggtatccgaaggaatagcgctgcccttggtatttcgcctgaaaacgctgttccatcgtgaagtcgggtgcatcagggaagccccagcggtcgcggataacctggtgcgtccgttcggcgagcccttcggccagctcaagagcaagcgcttgtaccgcatggcttttcaagtagtcgccttcctccttaaagcggttggcggcagctcttacatgcctgcccgccgttacggcaaagaacgagacataatcaagctctcccttcggtcggacgtaatcggaaatacagcggtacggaagcttttcctgccttggaaaaacaaacgtttcaaggatgctgtctttgttcactggatctaaaatatgaagcgaatccccgtcgctgtacgcagggaaaaattggtagacgaccgcaggatcgaaccagccgtgttcttttccgtctctcagcagctcgtcgatcagttctttcagctccagtgcttttggatgctgttcagccagtagttttttgactttccctttcaagccgagatgatggccgagcagcatttgttcattgacatacggcacaatataggaaaggtcgatgtttttcaaatagtgccgtttcaagtcttcaggctgaaagaccggcgccttcggaacgtgcgcccgtttttcaagcatttcaattacggctttcgtctgctttttttccgcgacggcggcgggtgcagcggcttcttttttctcgagaaactgcgacgggtccgtccgcagctgattggcgagcgataggccgtccatggcgtccttcgcgtataaaaccggccctttatattcaggcgaaattttcatgttcgtgaattttcttgaaagcgcggctccgccgaccatgatcgggatggaaatatccgctttatcgagatccttcgccgtaacgaccatctgctgcgccgatttgacgagcaggccggacagaccgatgatgtcggggttctctttgcggatcgcctcaattaactcctgcggtgtcactttaatcccaagatcgactaccttgtagccgttgttgcttaaaatgatgtcgactaagtttttgccgatatcatggacatcgcctttaacggttgccaaaatgatctttcctttgccgctgtcgtctttcttttccatatattgttcgagaaaggaaacggcagctttcataacctctgccgactgcagaacttcagcgacgatcagctcattgttgttaaacagccgtccgacctctgccatgccgtccatgagcggaccgttgaccacgtcgagcggggtggcgaattttttcaacgcttgttcgagatcgggaatcaagccttcttttgtaccttcgattacgtattcggccaggcgctcttcgagggaaagggacgttttcggctgtttgtccgcttttttctttccacgatagaagtcagtgaaggatgcgagcgttttatcgtcggtatgaaacagaagtttttcagccatctcgacttcttctttaggaatggaagcaaaccgctcaagcttttctgtattgacgatcgcgtaatcgagcccagcctgtgttgcgtggtacaagaatacagcatttaagatttcccggccgacgggcggaagaccgaatgagacgttgctgacgccgagaatcgttaagcattcagggagctgctctttgatgaggcggatcccttcgatcgtttctttagctgagccgatgtattgttcatcgcccgttccgaccgggaagacgagcggatcgaatatgatatcgctggccggtattccgtatttttcggtgagcagctgatgcgaccggacggcgacggccagcttttttgccgcggtgactgccatcccctcttcatcgatcgtgccgacgacgagtgcgcctccgaactgtttgacgagcggaaggatgtcagcgaaccgttcttcgccgtcttcaagattgatcgaattgatgatcgcttttccctgcgagtatttcagcgccttttcaattaccgttttgtccgtcgagtcgatgacaaacggggcttttacttttttcatcgctttttttaaaaagccttccatatcttccgcttcatcgcggtccgggtctgcgagacagatgtcgatgacatgggcgccgtttttcacttgggctctcgcgatttcggatgcttcctcaaatttatgctcggcgatgagccgcttgaattttctcgagccgatgacattggtccgctcaccgacaaaaaggggacgcattgtttcttcgtaaattaatccgtcgattcctgagacggtgtgcggctttgctcccgaaggaaccgtccgcggaggcagaagggctacttcatcggccagcgcttcaatatgggcgggcgtcgttccgcagcagccgccgacaatgttcagccagccttcttcagcaaacgccttgatttttttcgccagcgattgcggtgattcatggtattgcccctcctcatcggggaggccggcattcggatagcagctgacggccgtcctcgctagggaagaaagggtcctgatgtgatctgtcataaattccgggcctgtcgcgcaatttaaaccgacgctgaccggtttcatatgctcgagggagatatagaacgattcgatatcctggccggcaagcgtcgtgcccatcggttcgattgtgcctgacaccatgagcggaagggttttgccggttttttcgaaggcttgtctaatgccgataaagccggctttaacgttcagcatatcctggctcgtttcgaggagcaagaggtcggctccccccgtgatcagcgctcttgcctgttcctcgtagttatcgatcagttcgtcaaaggtggtgccgccggtgacggaaagggtttttgtcgtcggacccatcgcaccggcgacaaatctaggccattcaggagttgaaaacttttcggcggccgctttggcgagtttgactgaagcgaggttgacttcataggctcgatgcccgaggtcgtactcgtccagaacgagccgggtggctccgaacgtattggtctcgatgatatcggctttagcctcgagataggcttcgtggatgccctgaatgacatggggcgccgtaatgcttagaaattcattgcacccttcatatgcctcgcctccgaagtctgcggcggacaaaccggcgtcttggatcatcgttcccatcgcaccgtcaaggacgaggatttttttcttcagctggtcattgatgttagacatttgtcttctccttttctttctgatggatatatgccgtcagctcggcggttagatcggaccgcaaaaacggtgtgatcagataaatgccgttgaacaggtcgcacgccgcatcaagcagagagcgagcgatcgcgagcccttcctcggcctgtttttgtttgtcgtttcctgccagcgccatcttttcgcggattgaatcagacagcttgatgccggggatttcgttgtggatgaattccgcgttgcggctgctggtgagcggcatgacgccgatatagatcggtgtttcaagatgccgcgtttccttgtggattttaatgagctgctcctcggaatagacaggctgggaaatgaaatagtctgcgccgcaggcgatttttttctcaagccgtttcaccgctttgtcaatgtgtctgacattcggattgaaggcggccgccactgagaaattcgttttcttgccgagcggtttacccgaataggacaagccttcgttaaactgcttgatcaggctgatcaaatcgaacgatgtcaggtcatagacggaagtcgctcccggaaagtcgccgattttcgacggatcgccggtaatcgccagcacgtctgacagccccagcgtatcgagtcccattaaatgggactgcaggccgatcaggttgcggtctctgcatgtgatatgaatcagcgacctcatatcgaggcgctgttttaagagcgccccgcaggcgacattgctgatcctcggtgtggcaagggagttgtccgccaatgtcagtgcatcgattccggctgattttagctcctctgcggcgtgcaaaaatttctcaaagtttaattgttttggaggatcgagctcgacgataatggaccgtttctgctttgccagatcgtcaagagcaggctctgtcctttcgttttgaacggcaagcgccgctttctttctgattttcactcgtttttcggtgactggaggaagtcctttgacggcctcagccatcgctctgatgtggttcggcgtcgttccgcagcagccgccgatgatccgtgcgccttgattgcggaattcctccgcgctttccctgaaatattcatcatccgtctcataaacaagcctgccttcgacaagggacgggaggctgctgttcggatagacggaaagataggcatcttctaaaagcgggacttcttcaagcgctctgatcatatgataagggccgagacggcagttgatgccgacgacatctgcgccgagtgatgccagctgcttcagaccgtccgcaagcggggtgccgtcctgaagaacgccctcttcgtgcatcgagacattcaaaatgatcggcagctccgtttcctttctggcaatctttaaaacttcgcgcgcttcttctaagtcgtaataggtttcgagcagaagtccgtccggctgctcatttaacagaaggtagagctgttcgcggaagcttcttttaatgtcctcgagagaatacgagtttttgttgaacgtccggattccgccgagcgtaccgagaacataagcggagccggcggcggcgcgggcgaggcggacggctttttcgttgatttgttttgtttcgtcttcgagtccgtatctggacagcttgatgaagtttgcgccgtacgtgttcgtttgaataatgtcggcgccggcctgtacatacgcttcgtggacgcgtcttatttcttcgggcttggagatgttcagttcctcaaaacacctgtcgatcccataggaatacagaagcgtgcccattgcgccgtcagcgattaacgttttgttttttatatcctccaaaaaacccatcgttttcccccttaatcattcttaataaaacaaaaaagtcttctgggaagcagaagacttttcagcgacatttgtccgtcttcttatcttccaagcaggctgcttgctggatttagcaccttggtcatgaatattcattcaccggttgctgaggcttcatcgggccagtccctctgcctctcttgataagaacagctatttagtttctattgattacttttactcaatttaccgaaaatcgggggaataatcaacagtaaattaagaatttatcgaaaatttataaattgaacatcaatcggcaggtcggcttccctcaccatcgcgatgatttgctgaaggtcgtctttattttttccggttacgcggacttgatcgtcctgcacttgcgatttaactttcagacccgatttttttataaggttattgattttttttgcgttttctttgtcgatgccttgaactaattttccgcgctgtctgaccgtgccgcctgaagcgttctcaagctttgagtattcgatgtttttcgtcgggacgttccgcttgatcagtttgccgacaagtacgtctttcaactggttcattttaaattcgtcgtctgatacgagaacgagttcgtctccttcgagtgtgatgctgctttttgaccctttgaaatcatagcgtgtgccgatttccttgagagcggtctggattgcgttttgaacttcaggcagttcaacctttgagacgatatcaaatgagctttctttcgccatgtgaaaaaacctccatccattttacttatgagtcaattatagtagaataaggtgaaacttccaatatcgagcggttttgcctggccgcgatctggcaataatttgaacattggaggaataataagaaaaagaaaaacaggcggataagaaaggaagaagcagtatgaaacctggacagcagctaacattgaaaatagatcataaagcagattacggttactttttgacggacggcgaaacggcggtccttctgcatcagagcgagatcaccgaggatattgacgggagagaagaggtcgatgtttttttatatgtcgatcacgaagatcgccttgcggctacgatgagaaagccgatcatcagcgctgaacaatacggctgggtggaagtcgttgatgccgtcagcggcatgggcgttttcgtcgatgtcgggctctcgaaggacgccctcgttgcgacagagcatctcccgccgtatgaatcagtatggccgcaaaaaggagacaggctgtactgtatgctgaaaatcacggggcacggaaggatgtttgccaagccggcgccggaggacaagatcagcgaactgtttactgaagcttcacccggcctgatgaataaagagctcaccgggacgatctaccgcttgatcgcatcaggctcttttatgatttccgaagccggcatcagaggcttcatccattcttctgagcgaaaggaagagccgaggctcggcgaaaagctgactgcaagggtgatcaaagtaaaagaagacggttctgtaaatctgtcgcttctgccgagaaagcaggatgccttgtcggttgatgcggaacaaattctgacttatatgagatcgagaaacggcgcgatgccattctgggataaaagcgatccagaggatatcagagagcgcttcaacatgagcaaagcagcatttaaaagggcgctcggccatctgatgaaacaggataaaatctatcaggaagagggttggacgtacgagaaaaaataatcttgaggcggcgttccgatcgggacgccgccggtttcttacaggtgatgaggcttctttgattcctggtgtttaccggcttgtctgttcttttcggcgagccggtttttctgctggttgacggcgttattgtcaaccggctttttatcatcatctttcatgaggaagcacctcccgtcaaaatgtcgctcttagcttgctcactgccggcgaaactatgtactctcccaattgcgatgttttttgccgggaagtttatgccaccttgttccgtcagcatacacatatcataagacccaaaaaaggagacttggtatgaaacattgctgctcagtttacattcatcgcgtttcggcaggaggggtcgtcaacttcggcggtgcgtacaaaatttgtccgatcacaatggaaaaagtggtcgagggatctggaggcccggatgtcgcgacagctgctgccggctttcttgatggagcgcttgcgccggccgttgaggaagggacagtcaccgaagacagctgacgctgaggcctgcttttaaaaagcaggcctcagcgtgtcgacaaaccctcgcattcgttgtcaggcctgctaagtcggtgctcacgaataggagaaggatcggcggctaatcgcccaggcgtcctgcctgaacgccgccgtcgtcacttcctgtgaaagtccgctccgatgctcggccttcctagactgaaagggttttgggtcacgctgaaagaaggatgacaaaatcccaaaactaagagccgttttgggattttgtcaacaatctaaggcctgcttttataaagcaggcctctgttttatcttatcttttgtctttccccggaaaaaagaccgccaatgttccgggtccggcgtgggcgccgaccgctgaaccgatcatgttgacgacgatctcctccggctggaattcggcttcgatcatccgtttgacttcttcggccgtctcttcgtcatctccgtggctgatgccgaccgtctgtccgctcaaatcgacgcttctttccttcattaattcgatcatccgtctgagcagcttctttttgccccggattttttcaagggggacaagcttgccgtcatcaacatgcaaaagcggtttaatattcaacagcccgccgacaaatgccgatgctttgctgattcttccgcctcttgccaaataagtcaagtcatcaacggtaaaaatatgttcaagatgttcgcaaaagtcctttacagacgactcgatttcttgtattgtattgccgttagttgcgagtttgagggcgtgcttgacagcaagcccatagcctaatgaagcgcattttgagtcgatgatccgcaggtcgaaatcagggaactcctccttgacttcgtttgccgccatcacagccgtctggtatgttccggacagctctgaggaaaaggcgatatagagagcgggtttattttcgttggccagctcgctgaatgcgttcttgaacagcatcagagacggctgggacgttttcggcgctttgccttcgcgcatcgcttcataaacgtccagaggctgaatcgtcagaagatcatcgtattctttttcatcaagcagcacccttaacggaataaatgagatgcgatgttcatcataaaaagatttcggcaaatctgccgcgctgtctgctaaaaggtgaacgttcatttgaaccccttctttctaaaaaatggttgaaaaggacactaagctgtccttcggcatacttcgttttttaggtcaactatatcatatatttttacattgacgttttcaaaatattgttttaagggtaaaccaaatatatacgaaagtagcggaggaactaaatatggtcatagcggaagcaaaaaaattgttcattgtcatcatcggcgccttgttaaatgccatcggattgaatctgtttctgattcccgccgatgtttacgccagcggctttacgggggtggcgcagcttttatcgagcgcgcttgaccagtacagcccgatttatttttcaacggggacgctattgtttattttaaacattcccgtcgggattctagggtggctcaaggtcgggcgctcatttacggtctacagcattttgagcgtggccttgacgacggtctttttggggatgctccctgaggcgagcctgtcaaacgacattttgctgaatgccgtgttcggcggggtgatcgccgcggtcgggatcggcctgacccttaaatacggggcttcaacgggcggtttggatattattgcgatgatcctggcaaagtggaaagacaaaccggtcggcacctatttctttattttaaacggtgcgattattttaacagcaggattattgaacggatgggagaaagcattatatacgctcgttacactatatgtgacaaccagggtgattgatgccatccacacccgccacgccaagctcaccgttatgattgtcacaaagaaagcggaggagatcaaagaagccatttacgggaggatggtccgcggaattacaaccgttccggcgaaaggcgcctttacgaatgaacagaaagaaatgatgatcattgtcatcacaaggtatgaattgtacgacttggaaaaaatcattaatgaagttgatccaaaagctttcacaaacgtcgtacagacaacacaggttttagggtttttccgcaaagattaatgaaagggtgaatgaatgcggctgatttccatgattgtgatgctgctgtttgtcagtggatgcgggcaaaacggggatcaagtccccgataaggaggtatcaggggaagtggataacgggagtgtgacattgacggttgaacccgtccagaagcagggagaaatcgaatttcggatgtcggttgtaaaccatacggatgatgcggcagagtttgaattcagcagcggacagaaatttgagctgatcgtcagcgacaaagaagggaatgaaagataccgctactcgaaaggaaaaatgtttacacaggctttccagacgatgacgctcaatccgaaagagtcctacgattttactgatgtatggaaagaggtgcctgaacccggcacatacgaagtaaacgtgacatttttggggagatcggaacagtttgcaactttgagggccggcaaaacgtttgaagtgaaataaccatcaaaaaaggcatcccgggaaaggatgcctcttttgtattctgtcaggaaggatcggcggctgaatgaacaccgccacggtcacaggatgtgaccgttaatattgatccccattgaaaatagaatttttaacgatgacatagtctacgttgcggatcgcatcgagcttgtttcctcccgcataagaaatggacgactgcagatcctgttccatttctgtcagcgtatccatgatcgcgcctttatgctccacgtacatttttttgccttcgacatttttcttttcgcctttttggtactcagaagctgaaccaaaatattctttgtagagcttgccgtctttttcgatcgttgctccaggcgattcttcgtgtccggcaaacagcgaaccgatcatgaccattgtcgccccgaatctgaccgatttggcgatgtctccgtgggtgcggatgccgccgtcagcaatgatcggcttgcttgccgcttttgcgcaccagcgcagcgcagccagctgccatccgcccgttccaaaaccggttttgatttttgtaatgcagacttttccgggaccgatgccgacttttgtagcgtcggctccggcgttttcaagctctctaacagcttcaggcgttccgacatttcctgcgatcacaaagctgtccggaagatgttttttaatgtgctgaatcatattgatgacggcgtttgagtgaccgtgggcgatatcgatcgtgatgtactcgggtgtgagattctctctcgtcagctcttcgataaacgcgtattcttcatctttgactccgacgctgattgaagaaaacaaaccgcgtgccttcatgtctttaataaaatcgatccgtgtttccggctcaaagcggtgcatcacataaaagtaaccgttttccgctaatgaaacagccagcttttcatctataatggtctgcatattggccggcacgacaggcagtttaaatgtccttccgccaaactgcacggatgtatcacattcagaacggctcttgacgatgcactttgcaggaattagttgaatatcttcgtaatcaaatacattttccaatataaaaacccccaaaaaaacgaatatttattaataagttatttaaaatgttcgccttttataatgtacttccttttgttcccgatgtcaaatttttatgctttgagagcggaaaaataaaaaaggagccgtgccgatggcacagactcctctccggctgtcaaaagccggtgcggtattatgatagttgatctagctgctcctgaagattgtgaagctgtcgccgttcggcatcagttgaattggcatacgccgaggaaagggcgtttttagctcttgcaacggctttcgccttttcgcctgaatccgccgaagcttcagctgcatgtacggctgctttggccatttgaaacagttcgtttctcatttacagccctccgcattccgtcgggccgctcttctgttcagcctcttctaatgtggagcggtaagggaacctggcggcatgctgtttaagcgagtctttgccttgctgaataaaccgttttgatttgctgcgtttacccatcttgaattcccccttaacacaagtgacggtccggtgcggccgtcttctcatagtatggccgttttgaaaagccgtttatgaatggcaaattataaaattataaagcgaagtaatcctttaaaaagactgcgattccgtcttcctcattcgatttcgtgaccttgtttgcaacgctttttaccccttcgatgccgttgcccatcgctactccgcagcctgcgaactcaagcatttcaaggtcgttgtcttcatcgccgaaggcaatgacccgctcaggcgggattccgtagtagtccgtgattttctctaagccgaccgctttattgatgccgcttttaatcagttcgattacatgccacggggccgcccatcttctatggtcgaccatctctgcgtgtacgtctgacagataggagcggatcgccggaacatcctcttcttttgcgtgaatcaatacgcttgtcacatcctggccgaggtttgttcttaaatctccgactgtaatattcgggctgcccatcgtaaagacatcaatcagcttttcgtcatgataatgaaaataaacatcatcgacaatttcagcaaggatattatgtacgttgtacgtttcgctgacttcaatgatctgtttgaccacctcgagatcaagagatgtatggaagcgtccccagctttcatctttagggtgatggacaaacgcgccgttgaaattgacgatcggcgtatcgagctggagctgatcataatacatggagcttgctctgaacggtcttcccgtagaaatgcacacgtaatgtccatcttcccgcagcttgcggatgacttcgctggagctttccgagatggtcttgtcgtcttttaataatgtaccgtctaagtccaatgcaattaaatatggttttgtctccataaatgctcctttaatgtgaatttgaaagttctgacttacctatagtgtatctttttaccttctttattgtctacatgttaaacttatgatgatggacatcctaaaaggaggaagaaacagtcgtgatcataatcgaaaagcagcatatttcaaacattcctcttttgcatattgtaaaagaggagaaaaaagagaaagctcttcctcttgttttcttcatacatggttttacaagcgcaaaagagcataaccttcacttcgcatacctgcttgccgaaaaaggaatgcgcgtgattctgcccgaggctctctatcacggggaaaggaatgaacagctcacccaggaagagctcgccccgagattttgggagatcgtcacgaatgaaatcaaagagctggaagtgctgaaaaaccactttgaacgggaaaacatgattgaaaagggccgcatcggcgccgccggaacatcgatgggcggcattgtcacgctcggcgctttgactcaatacgaatggattacaactgccgtcagtttaatgggcagtcccgcctatgtagaattttttgatcagcagctcgcatttatgcgtgaaaagaaaattgaacttcctatcacagaagaacaaatcgatcagcagcgcgaagaactgaagcgttttgacttgagtctgcagccggacaaattgaacatgaggccgcttttattttggcacggcaaacaggacggcaccgttccatttgctttaacgcgccgcttctatgaatcgattattccactgtatgaagctcggcctgatttgctgcattttatcgaagatgagcgggccggacataaagtatcgagggaaggccttttgaaaacagtcgaatggtttgacgcgcacttgtaagcactatcgttttagaaaatgaacgaagtgcgttatactgatgaaaaaaggagtgaggaagagtggatgaagcattaaaagaaaacatcatgggcgcccttgaacaggtcgttgaccctgaattgggcgtcgatatcgtcaatctcggccttgtatacgacgtagatatggatgagaacggcaaaacagacgtgaccatgactttgacttcaatgggctgtccgctggcgccgatcatcgtagatgaagtcaaaaaagcgctcgcagatattccggaagtcaaggaagttgacgttcatatcgtctggaatccgccttggacaagggacaaaatgtcgcgatatgcgaaaatcgcacttggtatacaataaacgtttccagagcctgttcaaccgttgacaggctctttctcttccatataaagggaatgatcccggcagatggcctctcccgttattaatgaaaaagaacgcttttacaagcgttctttttttattgcaataactgctgccggcacattctccggtttgaaaagcggggaacccgggaaggtaagaacggagcacgaccgagccgaagaaaaggaccgccggcgggaggaaagaaccaatatgaaaggtgattgaaaaaatattaaatatacaattgaattaatttttattcatgttataatgttaaataatttcacaaagaccaagaaggtgaactcgttttgaaaataggtattataggtgctactggctatggaggggcagaaatcatgaggattatgaggactcacccttatgcagatgaatgcatattgtattcatcgagtgatgagggagcccgctatgacgccgcatacccgcaccttgtgaaactgacagatcaacacctgcaaccgatcgaggttaagaggattgcgaatgaaatcgattttttatttatggcagcgcctccggggatatccagccggctgacgccacagtttgatgcatatgacatacccatcattgatctgtccggcgatctcaggatacagaacccaagcgtctatgaaaagtggtataaaagggaagccgcgcctgaacacgtgcttcaaaaagcggtatacggactgtctgagctgaatcgggaagacattaaaacggcgcagtatatagccaatccaggatgttttccgacagcggttcttctcggcttggcgccgctcgtcaaaagcggcagcatcaacgaatcttttgtcatcatcgatgcaaaaacaggggtatcgggggcaggcagaaagccgtcgatgggcactcatttttcagaggtcaatgacaattttaaaatatacaaggtaaacgaacaccagcacacgcctgaaatcgagcagactgtcaaacagtggaactccgcatttaaaccgatcacattcagcacgcatttagttccaatgacaagaggcattatggcgaccatctacacagagctgaaagacagcatggatgccgaacagctgcagcttattttttctaaattttataaagattcatactttgtcagagtgagagaaacgggttcgttccctgccacaaaagaggtgtacggcagcaatttttgcgatatcggcgttaccgtcgatgaacggacgaacagagtgacaatcgtgtcagtgatcgataacttgatgaagggagccgcgggtcaagcggttcaaaacttcaacattatgaacggcttgagcgaaaccgccgggcttgaatttacgccaatttatccataagacgggagagaacaaacttatgattcaggtgagtcaagacagcataaaaaaaacagacggaagcgtcgcttcgcctaagggctatcttgcaaaaggggtccactgcggcctccgctattcaaaaaaggatcttgggatcatcatcagctcaagaccggcggtgagcgccgccgtttatacccaaagccactttcaggctgcgccgatcaaggtgacgcaggaaagcctcaaaaaaagcgcgcatctccaagccgtcatcgtcaacagcgccaatgccaacgcatgcacgggagagcagggcttaaaagatgcttatgaaatgcgccgtcaaagcgctgatatgctcgggatcgagccggatctggtggccgtgtcctcaaccggcgtcatcggcgaatacctcaatatggaaaacatcacaaaaggcatcagccttctcgccgagacagagcctgccgaaggcgatttcgaagaagcgatcttaacgacggacaccgtgatcaaacaaacgtgctatgaactgatgatcggcggccaaaaagtgacgatcggcggagcggccaaggggtcgggaatgatccacccgaatatggcgacgatgctcggctttgtcacaacagatgcatgcatcgaagaaagcgcgctgcaaagggctttaagggaaatcacggacgtttcgttcaaccagataacggtcgacggcgatacatcgacgaacgatatggtgctcgtcatggcgaacggatgcgccggaaatgagcgcctccatgaagaacacgaagattggccggttttcaaaaaaggcctgcagcttgtctgcacagacctcgccaaacaaatcgcaagagacggggaaggggcgacaaagctgatcgaggttgaagtgaacggcgcgaaaagcaatcttgaagcgcaaatcatcgccaaaaaaatcgtcggctcaaaccttgtaaaaaccgcggtttacggaacggatgcgaactggggcagaatcgttgtcgcaatcggggacagcatggctgctgtgacaccggagaaggtggaaatccgcctgggcggccaatgcctatttaaaaacaacgaaccccagccgttttcggaagagctggccaaaacatatttagaaaacagcgaagtgaaaatcgaggttttcatgcaggaaggtgaaggaaagggtacggcttggggctgcgatttaacttatgaatacgtcaaaatcaatgcgagctatcgtacgtaaaaaaggggatcacaatgggtaaaacaatcgtttttaaatgcggcggaagcgtcatccgcgaactctcggacgaattttttcaaaacctgaaagatctgactgaaagcggctggaaaatcgcgctcgtgcacgggggtggacccgatattacaaagatgctgaagaagctcaatattcgaaccgaattcgtcaacggacagcgcaagacgacaaaagcggttcttgaagtcgctgaaatggtcctgtccggttcgatcaacaaatttttcgttgctgagctgacaaagcacgggcttccggctgtcggcgtatcgggaaaagacgggggactgctccttgcagactatttaaatgaaaaggaatacggtcaagtcgggcgcattaaaaaagtaaacggccaaatggccgaagcgctcatggaaaaaggatttattccggttatcgcacccctctcgatgacggatggctgtgagaccttgaatgtgaacgccgatttggcggcgtcggctgttgcggcagccttgcgcgctgacaaattgatgtttgtgacagatgtcaaaggaattatgaaaaacgaagaaatgctgaaagagctgacgcccgaagacatcgaaagcctgattgctgaaggcgtgatctcgggaggcatgataccaaaagtgcattccgcaaaagaggctcttacagatgaagtggaagaagtaatgatcgtaagcgggaaaggatctttcctgacgaaagacgatttcatcggcacgaaaatcatcaaacaaaaggaggccgtatcgtgagtcacttatttcaaacgtacagccgctggaatatcaatattaaaaaagcgaaaggcacgatcgtccaggatgagaaggggaacgcctatctcgatttcgtccagggaatcgcggtctgcaatctcgggcattgccccgattcagtaacggctgctctcaaaaaacagcttgacgatgtctggcatgtttccaatttgtttcaaaatgagcttcaagaaaaggttgcacagctccttgccaaaaacagtgcaggcgatctcgtcttcttttgcaacagcggggcggaagcgaatgaaggggcggtgaagcttgcgcgaaaacatacgaaaaaaacaaaaatcgtaacctttcagcaatcgttccacgggcgcacgtatgcgggaatggctgcaaccggacaggaaaagatcaagcacggattcggaccgatgcttgaaggattccattacctcccttacaacgagccgaaagcatttgccgaattgcaggacgaaaaagatatcgcggcggtcatgctggagccgattcaaggcgaaggcggcgtcatcccggcgagcagagaatttctgcagagcgttcaagacttttgccgagataagcaggctctccttatcattgatgaagttcaaaccggaatcggccgcaccggtaaagcattcggatatgaacacgaagggctgtcacccgatatcgtcaccgttgcgaaagggctgggcagcggttttccggtcggagcggtcatcggcaaaaaagagctctcagaagcgttttcgccgggctcccacggcacgacattcggagggaacatgcttgcgatggctgcggcaaatgccacgttggagaccatttttgacagaagctttcttgaagaagtgagcgccaaaggagcatttttgcatcaacagctgaaagataagctccaatttccgcttgtgaaagatatccgcgggaaagggctgatcgccggaatcgagtgcaaagaacccgtgcagccgctgatcgaagcgcttcaaaaagaaggcctgctcgttcttcctgcgggtccgaacgtcatcaggcttctgccgccgttgacggttgcgaaaagcgaaatcaaagcggccgtggagaagctgaaagatgtcatggcaaatcattctgctgtaaagcagtaattttttttgaaatgaaagtataaaaattcatgaatatcactatttattcatcaaaggtgggcataagatggaaggatatttagttcttgaagatggtacatccttcagcggagaactggacggtcttgacggctgcaccggtgaagtcgtcttttttacgggcatgaccggttatcaggaggttttgacagatccttcatataaaggccagattattgtctttacgtatccgctgattggcaactatggaattaatggaagcgatgctgaaagcaaacagcctcaggtgagaggggtcgtcgtctatgaagcgtgcgacagattttcccaccatcaggcgacagaaagccttcgggaatacttggcgaagtgggatgttccgcttttgtcgcacgtggacacaagagcggttgttcagcatatcagggcaaaagggacgctgaatgcgaggctgacgaaacaaaaggacgacatcccggctccgcgccagctggaaaactatgcggcacaggtttccggacaaaacgaaaacggcgcttttggggaaggcaatacgcatattgcgctgatcgatttcggctataaaaagtcgatcgcttcatcgctagcaaaccggggctgcaaagtgacggtcgttccctatcaagagatggacggcattgcgaagctgaatccggacggaatcgtcctttcaaacgggccgggcgatccgaaagcgatccttccatatatggatgcactccggggtatcatttcttcctatccgacgctcggcatctgcctcgggcaccagctgatcgcgctcgcattcggaagcgacacgtataagcttccgttcggccacaggggagccaatcatccggtcatggacaaagagaccggacgcgtgttcatgacaagccaaaatcacagctatgtcgtcgatcgggacaccatcagcgaaaatgaattttccgtcaggtttcatcatgtcaacgacggttcagtagaagggctgatgcataaaacactgcctgtcctatccgttcagtttcatccggaagcccatccgggaccggctgaaagcgaatggatattcggagaatatttgcagaaattgaacgaagcaaggagagagatcgcccatgcctaaagaccaaaccatcaaaagcattctcgttatcggatcggggccgattatcatcgggcaggccgctgaattcgactactcaggaacccaaggctgcatggcgctgaaaagcgaaggctaccgggtgattctcgtcaacagcaacccggcgacaatcatgaccgatgaatcttttgcagatgaaatctattttgagccgttgacagtggaaagcctcacacaaatcatcaagcgcgaaaaaccggatggactgctcgccaatctgggcggacagacagcgctgaatttggctgtcgagcttgaaaaggccggcattctgaaagcgtacggggtgaagctgcttggaacatctgtcgatacgatcgaaaagggtgaagacagagaaaagttccgcgccttgatgaaagagctgaatgaacctgtgccggattcagaaatcgttgacaatcaggatgatgcgcttcgttttgcgctctcaatcggttttccgattatcgtgcggccggcctatacactgggcggaaaaggaggcggcatcgcggcgacaaaagaggagtttctgcctttaatcgaaagcgccctcctcgcaagtccgatccatcaatgccttgtcgaaaaaagcattgccggttttaaagaaatcgaatacgaagtcatgcgggacagtaacaatacatgcatcaccgtctgcaatatggaaaacatcgatcctgtcggcgtccatacgggagattcgatcgttgtcgccccgtcgcagacattaacggatgcggattatcaaatgctgcgttctgccagcttaaaaatcatttccgcgctcgatgtcgtcggcggctgcaacattcaattcgccttggacccggagagcaaaaactattatgtcatcgaggtcaatccgagagtaagccgttcatcagccctcgcctcaaaagcaaccggctatccgatcgcaaaaatggcggcaaaactggctgtcggctacacgcttgccgagctgaaaaatccgctcacagattcgacctatgcaagcttcgagcctgcgcttgactatgtcgtcgtcaaatttccgcgctggccgttcgacaaattcaaacaagccgaccgcaagctcggcacgaaaatgaaagcgacaggggaagtcatggcgattgaccgcaatcttgaagcggccctgcaaaaagcggtcgcctcccttgagctgaaaacatcaggaacacatttgcccgaacttggcggcgtatcttctgaagtgctgtggaagctgcttgagacccctgatgaccgccgtttctttgcggttatggaactgctgagcagggggacttccatcagcgaaatacacgagaaaacgaaaatcgatgattatttccttcatgtgttttctaacatcattcagctggaaaacacgctgatggagcagggagactcgttgtccgtcagccttttgaaaaaggtgaaagaaaagggatttaccgactttacgatcgcttccctcaccggaaagacagaagaagaagtgcgcgcgcttcgcaagaaaatgggcattgccgcatcctttaaaatcgtcgatacatgcgcggctgaatttgatgcgaagacaaactatttttactcaacgtacttcgggaaaagcgacggagacatctctcaaaaaacgaaaaagcgggccttgatcatcggttccggcccgattcggatcggccagggggtcgagtttgactacagcgccgtgcacggcgtcatgacgctgaaaagcctcggatttgaaacgatcatgctgaacaacaatccggaaaccgtcagcacggattatgaaatggcggaccgcctgtactttgaaccgattacacccgagcatattctcaatgtcgctgaagcggaagacatcgactttgcgattgtgcaattcggcggccaatccgccatcaatgtagcgcaagcgattgaaaaagcgggcatcaccctgcttgggacatcatcggaaacccttgacatacttgaagaccgcgatcaattttatcagctgcttgacgagctcggcatctcccatgccaaaggagaaacggcttcatcaaaagcggaagcggtgaaaaaagcgaacgaaatcggctatcctgtgttgatcaggccgtcatacgtgatcggcggaatgggcatgatgatcgttcactcagaagcggagctcagagagctgctgggcggggcatcgcaaatgccttacccgattctgatcgatcaatacgtatcaggaaaagagtttgaaatcgaccttgtcagcgatggcggcgatctctacatcccgacttatatcgagcatattgaaaaagcgggcgtgcattcaggtgacagctacgcgattttgccggggccttcggttactccggagatgaaaagcgccgctcgggatgctgccgcaaaaatcgtccgcaagctcggatttaaaggcattatgaacattcaatttatagcggattcggatgagctgctcatccttgaagtcaatccgagggcgagccggacggttccggttgtcagcaaggtgatgggagttccgatgatcccgcttgcggcgaaactgttagccggttcgtcactcaaagaactgaagcccgccgccaaaaattcacgcggcgttgccgtgaagtttccggtcttttcatcgcacgccattcaagatgtcgatttgaagcttgggccggaaatgaaatcgaccggtgaaggcatgtatgtcggcttcaatccggaaagcgccctgaagaaaatctttgcaggaatctggcaaacgaaaggctgcatttacatggaaggagccggcgagctccgttctctcgcagaacaggcgggcttcaccgtacagtcggacgattttccgggctggatcaaacggaaggacaaagcgctgcacatccatttagccgagtcaaaagaggcgagaaagcagaggatagaagccgtcactcacggcgtggcggtgatgacggaagaagagacggtgcgggcatttttgacgagcgggcatggaacgactaaagccgtgtcgcttaaagatttatataaaaaggaagtggagacatgtctactgtaaacatcggggcgacccgggagatcaatctgtcaggcaaggatttcttaagcctgaaagacttttcaaaagaggagatcgtctatttgctgaaagaggcagcggcaatgaagcgaaataaaattcaagacatctttaaaggaaaaacattggcgatgatctttgaaaaatcgtcgacgagaacgcgcgtatcgtttgaagccggaatggcgcagctcggcggaaacgccctgtttttaagcagtaaagacatgcagctgggcagaggggaaacgatcgcagataccgcgaaagtgctttcgcgatatgtggacgcgattatgatccgcacattcgaacacgaaaaagtcgaagagcttgccaagcacgccgagattcccgtgatcaacggattgaccgatctttttcatccgtgtcaagcgcttagtgacctattaacgattcaagagatgaaaggaacattaaaagggctgaaagccgtttatgttggcgacggaaacaatgtcgcgcattcgctgttaatcggctgcgcgaaagtgggatgcgacattacggtggcttcacccaaagggtatgagccgaatcaggacgtggtgaaactggccgagacattcgccgaagaatccggtgcggccgtcacgatcacaaatgatcccgtgtcagccgttcaacaagcggatgtcatctattctgatgtttttacaagcatgggacaggaggaggaagccgaagaacggatgaagatttttgctccttaccaagtcaacggaacgcttgtctcccatgccaagcctgattacatctttctgcactgccttcctgcccaccgggaggaagaggtcaccgcagagatcattgacggtccgaattcagcggtatttcagcaggctgaaaaccgcctgcacgtccaaaaagctttattaaaagcactgttatcttaaatgaaaaacagctgatccattgatcagctgtttttaggcgaatatcaaaacggcgatgccgatgacaaagcagtaaatcgagaaataaaccaagtttcctttcgccataatattcatgaaccagcgcaatgagaagtatgtagctataacagatgcgatgaacgcgaataaataaggaagaaaaagctctcctaaacgcggatcatgaaaaatatcggtaatgcttaaaatggttccgccaaggctgaccggtatgtaaagcaaaaatgaaaacctgagcgcggtttcagatttgaggccgagcgccatcgcaggaacgatcgtcgctcccgaacggctgatgccgggaacaagtgcaaccatttgcgaaaagccgatgatcacggcgtctctcagcctgatttcgccgtcgcttttccggccgcgcaaatttcgaataagaaacaatgccagacccgtaataagcaaagtaaccgcggtgatccggacgccgtctttaaagaaagccgaaatctcatcatcaaataaaacgccgatgacaccggcaggaatcgtggcgatgatcagatagatgataaacctgaagtccgcttttcctttttcattttttgttgtgacataagacagcccgtttaccgccagcctgaaaatatcgtttttataaacgagcagtacggcaattaaagaaccggcattcatcaaaagctcaaaactgaagccttcaatattcaagcccaaaaagtgctgtgccagcaccaaatggccgcttgacgaaacagggatcggctctgtgaatccctgaagcaaccctaaaaggatatacttgatcaacactaaaaaatccatgatactcctccgtttcccacaagttgtgatgcccttttaacagacggaatgtacaggcggttcgtttcaattttcagaacgcttttctcattaaactacacaaagcaaacagatgtaaagataaaatcgacatgttttttgagaaattggggcaatctaatggtaaaagggagtgaagcaaatgggacagcagcgtcaattccggccgggccaaaaagcgcccaataatggagtgtatgtggaaatcggcgaaacgggaagcatggttcagaaccctcagcaaatcaaattgagcgccggcgagttcttccctgaaacctccaatcataaccggctctggacatataaaagaaagccttaaaaaaacagccgtcggttttctgccggctgtctgtctaaagcaaaaaaccccacttttagaagccggggttttaatgttgacttgcatcctgtttaacaggcataatttctccaagaacaataacggctgcggtgatgataaagcccataatgacactggtttgaaggtcatacccagcaccgttcatggcgccgacaatgtagcaggccatctgcgtcaaaagaaatgtccagaaaaaagcgaccacaaatcgcacgtttcccacctcgtccttctcattcaattctaaaacttatcataccatatacatagccggctggaaaagacattttagtgaacaagacagggctttcaactctgctttcagaaatatcagaaagggtatttcattaaagtttacttttcatcatgaagactgggacttttccttattcgtttgctgcacgtacgacataaaataatgagcagattacggcaggaaggaggcgggcaagtgatgaaaataaccgaacgtttttttcaaatggattcagaatggaacgtggttcatcttccgtacaagccgaacggttttctggtgttcattttcggcgaccggaaccattttgtcggggaagattcgagcttctggcttcagcattacggacgaaatcagcttctaacgagcctgagaaacaaaggctataccctggtaaacagcaatttattcggcaggcactggggctccgaaaaagcggttgcatacgcgaaacagctgattcattacgtgttcaaacaagagatattaaatgaaaaaattcatctattggcggaaggcacaggggccctcattgcagatgagctccttcgctcaatcccgaaccaaatacgttctacagcgatggttaatccttgcctcgatcttcaggctcatcataaacgagaaaaagaaaacaagtttttctacaaacagtttattaaagaaattgccgaaagctacggaattacggagcgggaggcagccgattatccgttcaaaagcatatccccttatcacaatctcgtacccgttcatatttggcaaagactgaacgggtcaccgtatccgtatatgatccatgccaaaacgtttgaggagcgccagcttaaaggccgtcacagcgtggggcttaccctgcacctgtccgaacatcctcagcgcattcattcagcaatcgcgaactttttcaaaacgcatgaaaaagtcttatagagaatagaataatagcagcccgaaaatgatgaaaagggctgttttttgcttggttaaaaaagctgaaacgaaaggtggtccatcgaatgaagccggcacttgtatatggagcagatgagttcttcggcctttcattttgtgaacatctacttgaagagggtgttgacatagatgtaaagctggaacagacaagcgacgaaaaaaagctgatgtacctcgaagagcggctgatgtggctgggaagaaacgagcatttccgtctcatcgaaaaagagcttgaagccccgtacgaacaagtcttcatccaatacacaggctcagtgccggaagaagcgctggctgcaggcgttgaaaacaagcctgttattctgtttgtctaccaggaacaattggaagaggatttacgcgccggcatggaggaaaagggtgttgaactgatcgtgcttccggatctgttcggtccgtgggacgtcagggcagaggataaacaaaacagggacggagcgctttttgtgaacgacgcggccgcacaagccgctgcctgtgctgttgaaaaagatttttcagatttgcagtttgtacagaagacgccatacgataaagccgatgagatcattgaagaatggatcagacaaatgtctacatttttcgacaaaaaataagaaagatcttcctaatttacacttgaaaggatacaataaagatagatttgaattgctgtttttcgaaagggagttgaacatggcatggtgtacaggcttgtcgcgatttttttcattctcctggcgctaagcggctgcggacaatcgccgctgaaagggaaaattgaaaaagtcggtttgcttgtccctgatacgataaatgaccaagtatggggaaccaaaggatataaaggattattaagaatacaatccgtctacaatgtcgacgtctattataaagagggaatcgataatgacgctgccattaaaatggctgtagaagattttcacaaaaaaggcgtcaacctcatctacgggcacggaagcgaatatgaaaaagcctttaatgagatatgcaaagattatcctgatattcattttgttttaatgaactcgaaagccgaccaccaaaatgtgacaagcatatcgcttgaaggagaagcgatggggttcttcggcggaatgacggcggcccatcagtcaaaaacaaagaaaatcggcgtgctcgcaacgtataaatggcagcctgaagtagaaggattttccgaaggggctaaatacctcgatccggacattgaggtgatgacagaatatgtcggccagtgggacgacagcgaaaatgccgtcaaactgtatgaaaaaatgaagaaggcaggcgcggatgttgtgtatccggccggagacgggtataatgtccctgtcattgaacaaatcaaaaaggacgggctgtacgctatcggctatgtaagcgaccagtcggaattgggtgagaatgtcgttttgacaagcactatacagcatgtagatgacgcttatgaactcaccgccgacgagtttaataaaggaacgcttaaaggcggcaagcgctcatttgacattcaagacggcgtcatcgaaatgggagaattcagccctgttgtcgatcagtcatttcaagaaaagatgaatcggctgattgacgaatacaaaaaaacaaacaaactgccaaacgaacattgaggtgatcaagatgcacgaaaaatcaatggaatttttgcaaattgccatgaagtacgttccggaagcgaaagcagagatggagaaagcgggaatcgaactttccccggaaatgcttgagccattcatgaacttgtttacgaaagtgatggccgaggcttacgagctcggtaaagcggaagccggttcagacgcctgacttaaacgcccgcaaacgcttaaaaagccacttttcagaagaagtggcttttttatatggaaatcttatttttcaaagcgctgaccattgagccgatttctttaaacacaggcttcagctcatcgagcgaatccataatttctccaacctgattcaacacgtgcatataatcggcttcttgggatacttcagcgtcttcggcggtttccgcttccgcatccgtctccgtctcttcatgcctggcgggtgcatttgagccaaacatcatttttgtgaaaaaatcgtcgttcgccactcttcattccctcctttttcatatatatcactactatatgaaggttttggtctgctagattagacgaatatattgccaactaaaaaaaaatagggtaggattagtaccagatactaataattactcataacattagttggaaaaaatcatgaataaaggagtctttcctatgaaagctggaattattggaatcggccggtacatccctgaaaaggtgctgaccaatttcgacttggaaaaaatggttgaaacttctgacgagtggattcgtacaagaacaggcatagaagaaagaagaatcgcagccgaagatgagaaaacgtccgatatggctgtggccgccgcaagaagagcgatggaagatgcaaacatcgagccggaagatcttgatatgattctcgtcgccaccgttactcctgatcaggcattcccgacagtgtcctgcatgattcaagaaaagctcggtgcattcaatgcctgtgcaatggatatcagcgcagcgtgcgccggttttatgtacggcttagtcactggaaaacagtttatcgaagccggcacatataagcatgtgcttgtcatcggagttgaaaagctttcaggcattacggactgggatgaccgcaataccgccgttctgttcggagacggtgcgggcgccgcggttgtcggccctgtcagcgacgataaagggattctgtcctttgaactaggtgcagacggcagaggcggaaaacacttgtacttggatgaaaaagatcatacaatcatgaatggcagagaagtgttcaagtttgccgtccgccaaatgggtgaatccagtgtaaatgttattgaaaaagcgggattatccaaagaggatgtcgactttttggtgccgcaccaagccaacatccggatcatggaagcggcgcgcgaacgtttggagcttccggtcgaaaaaatgtcgaaaacggttcataaatacggaaacacatcagctgcttctattccgatttctcttgtggaagagcttgaagctggtaaaataaaagacggtgacgtcattgtgatggtcggcttcggcggaggtttgacatggggagccatcgccatgcgctggggccgctaaaagaaaggtgaggtgcaacttatgaatagtaaaagagtagtcattaccggattaggagctttatcacctcttggtaatgacgtcaaaacaagctggaacaacgcgatcaacggggtttccggagtcggcccgataacaagggtgaacgcggacgagtatcctgctaaagtagccgcagaactgaaagattttaagatagaagattatatggataaaaaagaagcgagaaaaatggaccgcttcacacaatatgccgttgtgtcggcgaaaatggccgtggaagacgcgggcctcgacattaacgaaagcaacgcagaccggatcggcgtctgggtcggttccggaatcggcggccttgaaacgcttgaacagcagttcgaaacatttttaacaaaaggaccgcggcgcgtcagcccgttctttgtaccgatgatgattcctgatatggcgaccggccagatttcgatctctctcggtgcaaaaggggtcaactcttgtacggtgacggcttgcgcgacgggtacaaactcaatcggcgacgctttcaaggtcattcagcgcggcgatgccgatgtcatgatctccggaggaacggaagccccgcttacaagaatgtcatttgccggcttttcagccaataaagcgctatccactaatccggatccgaaaacggcaagccgtccgtttgacaaaaaccgcgacggcttcgtcatgggagaaggagctggaatcgtcgttcttgaggagcttgagcacgccttaaaccgcggagcgacaatctacgcggaagtggtcggctacggatcaacgggagacgcctatcatattacggcacctgcgccaaatggagaaggcggcgtcagagccatgaaagaagcgatcaaagatgcgggtctgtcccctgtggacattgattatatcaatgctcatggaacaagcacgccgtacaatgataaatttgaaacgatcgccattaaagaagtgttcggagagcatgcctacaagcttgccgtcagctcgacaaaatcgatgacagggcacttgctcggggctgccggaggcatcgaagcgattttctccgtccttgccattaaggaaggcatcattcctccgacaatcaatatcgaaacgcctgatgaagattgcgatctggactatgtaccggatcaagcccgccgccaggacgtgaatgttgtgctcagcaactcgcttggtttcggcggacacaacgcaacgctgatcttcaaaaaatatgaataacccgcaatataaacggctgccattttaaatggtggccgttttttttagcgtgcataccatacagatgaaaaaggagtgtgatctaaaatgagtatagcaagcacgtatgaatggcttgaacaggcttcatccgtgcgggaattgccaagctttctcctgccgtattttaaaggcgcttcaaaagcggatgcggcggcgattgtcagccacctgcagatccacggcttgttccgttcgtggacggacggcgaacgtacgatgaagcagcttaaggaaaacggcgtatttcagcatgtcagacgggaagaacagctgctctgcaaaagatggaacgggccggatgttccgattttcatcctgccggtcgatgaaagaaaccgcaaaatccgcgtcgaattcggctcgaaatcaggcctcgcgttcagcgacaaattatttttgtttttatcggccgatcttccccggtcttcaatttctgcgatcatgacacacgaatataatcacgtttgccggttagaaaatatgccgaaagaagaaaaaaagatgacgctgcttgatacaatcattctcgaaggccttgcagaatatgccgttttcgaacggctgggagaagccgaaacagccgcatggacgtcatattactccgaaaagcagcttcgtcatttccaggaccggttcgtaaagcctcatttcgacctgcgccgacacgatggccggctattctccaatattttatttggaaaaggacattaccctgacatgctcggatatgctgtcggttacagtattgtgaaaaaatatttatcggctcgaaaattgaaggttgccgatgttttagcctttccgtcagaagactttataaagctatcgctttaaaatactaaaattatgggattaaattaatattattacaaaaaatcaaaaaactccttgcttttgtaatgattatgtaataatatacaactataaaattttaagataattcagtcatattaagaaaattctaaaaaagtaatatattagttttttgtgatatttaacttctggtctatggaaggggaatctggatgagcgcattgctggaagtcaatgatttaaaaacttatttttttaggaaaaaacagccgatacctgcagtggacggcgtcgatttttcaattaaaaaaggggaaaccgttgcgctggtcggtgaatcgggatccggtaaaagcattacctctttgtcaatcatgggactggtcgagggctcgggcggaaagatcatgagcggctctatcaagctcgaaggacaggatctcgttacatacaaagaacaagatttatgcaagatccgcggaaatgaaatctccatgatttttcaggaaccgatgacctcgctcaatccggttttgacgatcggcgaacaaatcacagaagtgctgatctatcataaaaagctatcgaaaaaagaagccgccaaaaaagcggtagaattattaaagcttgtcggattttcaagagccggcgagctgatgaaagagtatccgcaccgcctgtcgggcggcatgaggcagagggtcatgatcgccattgccttaagctgcaatccgaagctgctgatcgcggatgaaccgacgacagcgcttgacgtcaccattcaagcccaagtgctggaactgatgaaagacctatgcgacaaattcgatacctccatacttctcattacccacgatctcggcgttgtgtccgaaattgcggaccgcgtgatcgtcatgtattgcggacaagttgttgaaaatgccacagtagacgagctattcgacgaacccctgcatccctatacaaaaggactgttaaactccatccctgtcattgaaggctccattgaaaaattaacagccattaaaggaaatgtgccgacgcctgacaaccttcctgccggctgccggttcgctccaaggtgtccgagcgcggtcgacaaatgctggggggcgcagccagacttgaaaacgcgtccggacggccggtctgtcagatgttttttatatgaggagggagaataagggatgacttcatcagctgaacaattacagcccggacaggaaatgaacccgcaagaatcccttctggagctgaaagacgtcaaaaagtactttccgatccgctcagggatttttcagaaaaaaatcggcgatgtcaaagcggtggacggcatcagcttttcgcttaaacgcggcgaaacgctcggcattgtcggtgaatcgggctgcggaaagtcgaccgccggacggacgatgatccgcctttataaaccgacggcagggcagattttttacaaaggccgcgacatttcaagtttgtcggaagaagctttgagaaaaagcgtccgcaaaaacatccagatggttttccaagatccgtttgcctcactgaacccgagaaaaacgctgcgttccatcatcaaagaacccttcaacacgcatcatatgtacaatttcaaagagcgcaacgaaaaagccgaagagcttttagccaaggtcgggctgcacccgtcgtttgcgaaccgctatccccacgaattttccggggggcagcgccagcggatcggaatcgcgcgggcgctggctttaaatccggagcttattatcgccgatgaaccggtatccgcattggacgtgtcaatccaggctcaagtgatcaacctgatggaagagcttcaggaagaattcaatctgacatatttgttcatttcccatgacttgagcgtcgtccgccatatcagcgacagggtcggcgtcatgtatctcggcaaaatgatggagctgacagacaagcatgagctgtacggcaacccgcttcatccatacacgcaggcgcttctgtccgccgttcccgtcactaggaagaaaggcggaacaaagcgggagcgaatcgttttaaaaggcgagctgccgagtcccgccaaccctccgaaaggctgtgtctttcatacgaggtgtccggccgcaaaagcgatttgcgcggaagccgaacctgctttcaaggaagtgaaaacaaaccatttcgtggcatgtcacctttacgaataaaggggaaggccgtcacatattaaatccttgagagggggaatgtcttctttaaaaaacgggggtcaatcgggtggaaagaaggacaacagtttaataagggggaattcataaaatgaataaacgcaaaacaggattttcaattttaagcttgctgctgatcttatcgatttttctaacggcctgcaacagcggcgaagtcggaggggatgaaaaagaaggcaaatctgacgggaagccgcagcagggcggagatctgattgctggatccacaggtgaaccgacgctgtttaattcactgtattcaactgatacagcaagttcagatattgaaagactgatctacaacactttgttagacgttaatgagaaacttgaagtggaaaaccaactcgctgatgaagtaaaggaatcggaggatgggttaacattcgatgtgaagctaaaagaaggtgtcaagtttcacgacggtgaagaaatgacagccgacgatgtcgtttttacttacagcattccgatgagtgatgaatacgttggagaacgcggctcaaactttaaaatgatagagtctgtcacgaaaaaaggtaaatatgaagtgcagtttaaattaaagaagcaggatccgtatttttacaatgttacacttgccagttacggtattctgcctaagcacattttaaaagatgtcccaatcagcaaactcggtgaacacgaattcaatcgaaagaatccgattggaacaggaccgtttaaatttaaagaatggaaagaaggacaatatgtaaaggttgaggcttttgatgattattatgccgggcgtcctcatttagattcgatcacgtataaaattattccggattcaaatgcagcgctgtcacagctgcaagctggagatgtcgattacttggtcgttacaccaggaccagactataaaacggccgagaaatttaacaatgtgaagatggaaaccgatttaggtttgaattatacgtatatcggctggaacgaaagaaatgagctgtttaaggataaaaaggttcgccaagcgctgacacatgcgcttgaccgccaggcgctcgttgaccaagttctagatggagatggggaaatcgcgaacatcccggaaagcccgctttcatggaactacccggataacaaagataagtttaaaacgtttgaatacgatccagagaaagcaaaaaaactgctcaaagaagcaggatggacagactcagatggtgatgggattttagataaggacggcaaaaagttttctttcgttattaaaacgaaccaaggaaacaaaacacgggaagacctcgcggttgttgttcagcagcaattaaaagaaattgggattcaagcaaaaccgcagattgttgaatggagtgctttaattgaacaaatgaacccgccgaattgggattttgatgcgatgatcatgggctggagccttgctacgttccctgatcagagcaacattttccattcgaaagaagctgaaaaaggactaaactatgtttggtatcaaaatgaaaagcttgataaactgctggatgaagctaaaacgttgaaggaccgtgaagaatataaaaaggcgtatgaagatatttacgaaattctggcggaagatcagccgtatacattcttgtattatacgaattaccatagagcgatgcctaaaaatatgaaaggctacgtattccatccgaaagaagatttctataaagccgaagactggtggctggatcaaaaataacgagaatcccttgagggaagtgtagcttgcagcttccttcccttccttcttaatgacttttaaaaaaggggataaaaaatgattacatatatcattcgaaggacgctcatgtcgattccaatattatttggtattacaattttgtcatttgcgattatgaaagcagcgccgggagatccaatggcattgatgatggatccgaccatcagcgcgggagaccgtgaaaaattcattgaaaaatacgggttggatgaacctgaacacgttcaatatttaaagtggctcggaaatatggttcaaggtgacttcggtacttcaatcgttagaaaaggaacgccagtgactgatttgattatggcgaggctgccgaatacgttattgttaatgctcgtttcaaccattttggctctcctcatatcgatcccgcttggagtgctttcagctaggcggccatattctaaattggattatggcatcacattcacatcatttatcggtcttgctgtcccaaatttttggcttggactgattctaatcatgtttcttgctgttaatttaggatggtttccaaccgggggcgttatgactctgaatgccgattttagtttatgggatcgcattcatcatctaattttgcctgcattcgtcctggcgaccgcagatatggcgggactcacccgctacacgagatcgagcatgcttgatgtgctcaggcaagactacatgcggacagcgagagcaaagggttttaaagaaaatcgtgtcgtgtacaagcatgggcttcgaaatggtttgcttccggttattacgatctttggtctgatgattccttctttcatcggcggagctgtcgttactgaacagattttcagttggccaggacttggaaagctgtttgtcgactctgctttccagagggactatcctgtcattatggcaatgacggttatttcagccacacttgttgtcattgggaatttagttgcggatattctttatgcaatggtcgatccgcggattgagtattaatgaaggagggaattgattcatgacacagacaaatccatcgacaccttcgccggagatcacattgcaggaaaatgtcgcaccaaagcccgagacaatgacaaaaatcttttttgaaaagttttataaaaacaagctggcggtaattggaggagttttattatttattattatcctatcagcgatttttgctccggtgatcgctccatacccgccggaacagcaaaaccttctgaataagctaaaaccgccaagtggtgaacatctaatgggaacagacaagtttggccgagatattttcagccgtttactttatggggctcgggtttctttacttgtaggctttgcctctgtacttggatcgattacgataggtacggtggtcggcgcaatcgccggctactttggcggaataatcgacgctattatgatgagactggtggatattgtattatccatacccgacatctttctgttaatcacgctggtcaccatcttccagccgggcatagataaactgattttaatattcgccttgacgagatggacgacgacagcgcgccttgtccggagcgagtttttgtccttgaggtcgagggagttcgtcttggcggcgaaaacgatcggtacaagaaattacaaaatcattttttctcatatccttccgaatgcgatggggccgattatcgttgccgcgacgctttccgtcggtaccgtaatccttgcggaatcggcattaagctatcttggattcggggttcagccgccgatggcaagctggggaaacatgcttcaggatgcacagaactttacgatcatgatccaggcgtggtggtatccgctgttcccgggcctgatgatcctgctcactgtgctgtgctttaacttcttaggcgacggactccgcgatgcgcttgatccgaagaatattaaatgatttatgcagtgtattacagaggaaatattttaacaaaatggaaggtcaatagatttagtttcaatgaatgtatgtagtggacattgaacgaatgtttcctgttagtcgataaagaacactttcataaatgaggtaccaaagggaatatcattcgtaaatctttggtatctcactttgttcaaacagaagcaggtcttccaactcctgaagatcttttggaactgttagatgaacaaatgggcgctgtagcaaaaaaataaatcgctttgttaaatgaatagaggttttaacgatgttaagcgtattgaaaaataaaaactttttatttttgatattagggcgtttggtaaccaatattggggacagtatgtatacagttgcggcaatgtggcttgtgtttgatttatcaaaaagtacattttattccggattagctggttttttgacgatgttcccaactgttttgcaatttttaacaggtccgattgttgataaagtcagattaaataaagttttggtttggagtcaactcatccaagctattttggtgttgattattccgcttttttatttcattggatatttgaacatttggatcatcatgatgattatgcctcttatcgtattcattgagcaatttacttatcctgcgcaatctgccgcactgcctaaaataatcaaaagtcaagatctagttaaagcaaactcacttatgtcattttcatatcaaggtacagatattatatttactggtattgcaggtattgtgattgcttcggcaggagctataagcatatacttagttgactctttcacttttttgttagcggcgctgttttttaagtgcgtaaaattagaacaaaaaaatgagatagaacataagccccgattccacttcaaaaaagtcatacacaattatacaacggatataaaagagggatttacactcattcgtcattccctcattccaaaaatcctcttgggctcgatgatttctaacttcatgcttagtgcgacgattgtgattttgccaagcttctcttcgattagaggaggagaagaatactatggatattatttggcttccatgtcatgcggtttactgttaggttcaatattcgcaacagtgtttggccgattcgcgataggatcacttacgatatacggatttttcatttcaggggttttatggagtatttcggcgatcgccacctcttcatacatatcgattattttatttggtttgtctcaaatatccatcggcgtgacaaacgtcattttcatgtccattttgcaaagcatactgccggaagagtttatagggagagttttttcttttatcgcaagtttgacaagcatagcagctccttttggatctttgctgggagggtttaccgcgtcattgatcggcagcgataaggttttctttataggaggaattgccatgctgtttgtatctgtttattgggtgtttcagtcttctttaagatcaattccttcatcagaaaaaataaacgctaaagaatacagcttttttacaaacgtgttgaataaataatgtgtgaattgcttcattcagtcatcatgattttgcccattgtctggactccgcgatgcgcttgatccgaagaatatgaaataaaaagctgagggattgccgcccttggcttttttttaacggcgattgccataatctcatccgcttggaataaattcctgcccccttgcctatactgtggacaacagtttttattaaaagtgaggggttagaaatgttgtttcttcatgatgtgtgggtgaattggtttgagggagaagaaaatggctacaacgtctgccactttcatgaatggcggaaggaagacagtgttgaattgcttgaccaggtgcctttgttaagggtgtcgtccgttttgtttcactacatagaaaatgatttgtcagagcttccggccgaattattgaacgaggttcatcaaaaagcgtatattcgtaaaaatcatgagcggacacagcttgatcattgtttcgtcgtaacggacggcattggtattctcgcggtcgatacggccggttacacaataccggtaagaaaaagccgcctcattccgagacaggagcagctcgtttatgaaatggtgaaggacgttgaagcggaaacttacgagtttgcaccagagaagctgcaatcttccaaagaataccacattttatctttatcaccggagcatgtcagaggattaacgagaaaagaacgccagctcaaacagctgctgttcatggcgctcgatcagctcaaagggctccaaaatcgggccgagatcgcttattggtacaccgaatggaatccgtatatgtatgaacagatcaagcgcatgacatttgaagaaatctgggacatgcttttcaatgagacgatcgacggatggtcagacaaacacagggacttttgtgaaaatttgattaaaggacagccgttttttgaaaagctttgggaaattgagaatgagtctaaagtcaactaaattaagaatcaagactgccggaagtacggcggtctttttatttgtaaaagcgaaaattctatattgaaaaataaaaaatatgagctgtctttctgacaaagcggtcaatgaaggactggagacatgtgttttgaatcatttattatagaaatatcgtgatccggaggcaagtgaatgcggagctgcggctgttctctatgaaaaacaccttccgattatcgtacaatcggaaggtgtttttggatcagcgtctttttcggccgagtcccatcgcgttttccattttttttagcatcttgtttgctgtttgatttgcgcgttcggcgccttcgtccaaaatccggtccagctcttcagattcgatcaattcgtggtaacggtcttgaatcggtttcagcgcgccgatgacgacttcggcaaggtctgatttaaattcgccgtagcctttgccttcgtattttgcttcaagctcttcgattgaggcttgtccgagaatcgaatagatcgtcagaaggttggatacaccgggtttgttttctttatcatatttgacgattccgtcggaatccgtgacagcgcttttgatttttttctcaagctgttttggttcgtcgagcagggtgatgaacgctttttggttcggatctgatttgctcatctttttgagcgggtcggcaagtgacataatgcgggcgccgaccttcggtattttaacctccggaaccgtaaaaatgtcattatatttcttattgaaacgctccgccaagttccgggttaattcaagatgctgcttctgatcttctccgacagggacgacgtctgttccataaagcagaatgtccgcagccattaatggaggatatgtcaaaagcccggagacgacagcttcttttccggctgatttatctttgtactgcgtcatgcgctcaagctcgccgatgtaggcgacacactgaagcatccatcccgcctgggcgtgtgcaggcacttccgattggataaacagcgtcgcttttttcggatcgaggccgatcgccaaatacagcgcggcaaggttccggatgttctttctcagcgcgagccggtcctgcggtactgtgatcgcgtgctgatcgacgatgcagaagtaacagttgtagtcatcctgcaagtcgacaaactgcttcatcgctccgatatagttgccgagggtgacagagccgctcggctggataccggaaaaaatcgtttttttcatgtgaatccctctttccatttcaaaataaaaaggcccattcttcccttaaaagaaaagggacgaatgaaccgtggtgccaccctgattatttcattatggtcaaaatgaaatcgctttagacgtttgtaacggagtcttctccggctgagcctacttatccgtgttcggtcagctgctccgaagcccattccacattcgccattatccgctcccagcaccgcggactctctttaaatgggaagaaatgtgtactcttcttcttcatcgcatgttattcataattttattatatataaattttaaatgaaagtcgacagccttggggaaaagaaaacgaataccgggctgaataaagttggcgcggcggcatctggttcgatataaagaatggttaatgttatacgtgtaaaacgttttaacctgtaaaacataaactttccttttaatgtggttacgctttaaaacagagaagtgtatttgtacatttggcagaaaacctgacaatcataaatagtttgaataaaaaaataattgaaaattaatattgcaataaattattctattaattataatgaatttgttcacctcggtgttacaggtttcttacataacaaatattcagaaaagacgaaacagaggaaaaagtatggcaagtgggcctattacttttttatgataaatctgaatgttcaggagtaaggaactaaaaaaacaagaaattgggggggtttctctttgaagaagcgtttgtcatttatcagtttaatgctcattttcacactcgtcctcagcgcctgcggcttcggctcaagctccggtgacggcggtaaaaaagacagcaaagggaaagacacattaaatgtcaacattaaaacagaaccgttttcactacatccgggactcgcaaacgattcggtgtctgcaaacgtgcttcgtcagacttttgaaggattgacgacaatcggtaaagatggaaagccggttgaagcggcagccgaaaaaatcgaagtcagcgacgaccaaaaaacatacacattcacgctccgcgacgcgaaatggtcaaatggagatcctgtaacagcagaggattttgaatacgcatggaaatgggcgctcgaccctaaaaacgaatcgcaatatgcgtatcagctttactacttaaaaggcggagaagcagcgaacaccggcaaagggaaaattgaagatgtcggcgttaaagctgttaatgataagactttaaaagtcgagcttgaaaaaccgacaccgtattttactgaactgacagcattctacacatatatgccagtcaataaaaaggtagcagagaagaatgcgaaatggtacacaaacgcagatgagaactacgtatctaacggacctttcaaaatggcgaaatggaagcacagcggaaacatcgtactggagaaaaacgaccagtactgggataaagacgctgttaagctgaagaaaatcaatatggcgatggtcaacgatccgaacactggtctgaacatgtacaaaaaaggcgagctagactttgtaggacagccgcttgaccagatttcaacggatgcgattccaagcctgaaaaaagaaggcctgaacattgatccgttcgcatcggtttacctgtacaaattcaacactgaagcggctccgctgaacaatgtcaacatccgtaaggcgctgacatacgcgatcaaccgcgaagcgatcgtcaaaaacatcacgcaagcggaacagctgcctgcgatgggattagtgccgccggcggtccacggctttgaatccaacaaaggctatttcaaagaccatgatgtcgataaggcgaaagaacacttggaaaaaggcttgaaagagctcggtttgaaaaaagcgtcagaccttccgaaaatcacgctttcctacaacacggatgaagcgcaccaaaaaatcgctcaagccgttcaggaaatgtggaacaaggaactgggcgtagatgtggaattaggcaatgaagaatggaacgtttacatcgataagctccatgccggaaactatcaaatcggccgtttaggctggaccgccgactttaacgacgggatgaacttccttgaaacataccgcgacaaagaaggcggaaacaatgatacgaactgggaaaacgcgaagtataaagagctgctgaataaagcatcaagagaaactgattcagcgaaacgcatcgagctgatgaaagaagcggaaagcatcatcatggatgagctgccggtcgcaccgatctacttctacacaatgccgtatcttcatgatgaaagcttaaaagactttgttctgaccggtacaggtgagatctatttcaaaaccgcgcattttgaataaaattgcatgaaagtatatggggcttagactttccccccatatacttttatttatgaaaagaagttaatagactgaatattcggaggtgtgtaaaattgattaaatatttaggccgtcgtcttgtttatatgttaatttctctctgggttatcgtaacagctaccttcttcctgatgagagcgataccgggcggacccttttcaggcgagaggaaacttccccctgcaattgaagccagtctcaattcctactatggtttagaccagcctctttttaaacaatatctcgattatttagtatcggtagcaaagtgggatttcgggccgtcatttaaatataagggacaaactgtgaacgacttgatcagctcagggttcccgatttcttttacactcggattggaagcgatttgccttgcgctcgctttcggcgtattgttcggcgtgatcgccgcgctgaagcgaaacaagtggcaggactacacagcgatgatcattgcggttgtcgggatctctgtgccgaacttcatcatggccgcgcttctccaatacgtgctggcaatgaagctgggcatgtttcctgtcgcgcaatgggagtcatggggacatactgtgcttcctgcaatcgctgttgcctcgatgccgatggcgtttatcgcccgtttgacgcgctccagcatgcttgaagtgttgagcagcgactatatccgcacggcgcgtgcaaaaggtttgagcacatcagccgttacgtttaagcatgcgatacgaaatgccatcatgccggttgttacatatatgggcccaatggcggcgtccattttgacaggaacgtttgtcgtcgaaaaagtcttcggtataccaggactcggcatgcactttgtcacaagcattacgaaccgagactatacggtgatcatgggcgttaccgtcttcttcggggcaatcttgctgctttgcgtcttgattgtcgatcttttatacggcttaattgatccgcgcattaaattgtttggcgctaagaaaggggagtaagaggatgcagcaaataccaaaagacatgtttgaacctgcagctgttgaccatagcgaagccgaaaagatctcaaagaaaaacctttctttttggacagacgtattcttgagatttaaagaaaacaagctggcgctgtttggactggtggttctgatcctgatcgctctgatggctatcttcgcgccggtgttctcaagctttcaatatgaagaaacagatttaacgaatgcgaaccagccgccaagcggtgagcactggtttggaacagatgaccttggaagggacgtattcgtccgtacatgggtcggcgcccgcatctcgctgacaatcggactcgctgctgcgctgatcgacgttttgatcggtgtgatatggggtgcgatttccggcatcagaggcggacgtacggatgaaattatgatgagaatagcagatattttatgggcgattccttctttattaatgaccatcctgctgctcgttgttatgggaaaaggcctgatcacgatgatcgtggcgatggttattacgggctggatcaacatggcgagaatcgtccggggccaagtactccagcttaaaaatcaggagttcgtactcgcctcaagaacattgggagcgaaaaactcgcgcattatcagaaagcacctgctgcccaacatcatgagcccgatcttggtcaccatgacattaaccgttcctacggctattttctatgaggcgtttttaagctacctcggcctcggggttccgcagccgcttgcaagctggggaacgatggcaacagacggtgttcagggattggaatactacccttggcgcctgttcttcccggctacttttatctgtctgaccatgtttgcattcaacgttatcggcgacggactgcgcgacgctttagatccgaagctgcgtaaataaaggagtgagaaagatgaaacacttacttgaagtgaaagatttagccatttcttttaaaacatacgccggagaagtacaggcgatccgcggcgtcaactttcatgttgacaaaggagagacgcttgcgatcgtcggtgaatccggatcaggtaaaagcgtcacttcacaggcaattatgaaactgattccgatgccgccgggctattttaaaaacggacaaatcttatttgacggacaagacctggttccgaaaacggaaaaagagatgcagtcgatcaggggaaaagagatcggcatgatctttcaggatccgatgacttctttgaaccctacaatgaaagtcggccgccaaatcacagaagtgctgtttaagcatgaaaaaatctcaaaagaagaggccaataagcgggcggtagagcttctcagccttgtcggaattccgatgcctgaacgccgcgtcaaccagtatccgcacgaattcagcggcgggatgcggcagcgcgtcgtcatcgcaatggcgcttgcggccaatccaaagcttttaattgcggacgaaccgacaacggctcttgatgtgacgattcaggcgcagattttagagctgatgaaagacctgcagaaaaagatcgagacatccatcatttttattacgcacgatctcggcgttgtcgcgaacgtcgccgacagagtcgccgtcatgtacgcgggacagattgtggagatcggtacggtcgacgagattttctacaatccgaagcatccgtatacatgggggctgctggcttcaatgccgagccttgacaatgacggtgatgaggaattaatggcgataccgggctctccgccggatttgaccaatccgccgaagggcgatgcctttgcgttaagaagcccgtacgcaatgaaaatcgattttgaacaggagccgccgatgtttaaaatatctgatacacattatgtgaagtcatggcttttgcatccggatgctccaaaagtcgagcctccggcggctgtcaaaagcaagatgaaggagtttaaaaatcagtatgaaaaaccggttcaagtgaaagaaggtgaatgacatggcagaaaaactgctcgaaatcaagaatttaaaacagcacttttcaacgccgaaagggattgtaaaagctgttgacggaatctcttttgacatttacaaaggggaaacgctcggtcttgtcggagagtccggctgcggaaagtcgacgaccggccgttcgatcattcgtttgtatcaagcgacttccggagaagtcttgtttaagggaaagaatgtccacgacaaaaagtctgccaaggaccttctcgaattcaaccggaagatgcagatgatttttcaggacccgtatgcatccttgaatccgcggatgacggttgccgacatcatcgcagaaggtattgacatccacggtttggccaaaacgaaaaaagaacggcttgagcgcgttcatgaactcctcaatctcgtcggcttaaataaagaacacgcgaaccgctatccgcacgagttttccggcggacagcgccagcggattggaatcgcaagggcgctggcggtcgaaccggaattcatcattgccgatgaaccgatctctgcactggacgtgtccattcaggcgcaagtcgtcaatttaatgaaggatttgcaaaaggaaagaggactgacataccttttcatcgctcacgatctgtcgatggtcaaatatatcagcgacaggatcggcgtcatgtatttcgggaagcttgttgaattggcgccggcagatgaattgtatgaaaatccgcttcatccgtatacacaatcattgctttccgccattcctctgcctgatccggattatgagcgcacgcgcgtgcggaagacgtatgatccgtccgtccatcagctgaaaggcgacgaacagatggagctccgcgaagtaaagcccggccatttcgtcatgtgtacagaggaagaatttaaagcctatcaatccaaataaacgaagcaggaagacagccgtcacaaggctgtcttttttgatgcagaaccacagccggcaatttttttgagaaaaaatttgaaaccttagcgtaagacaaccgtcttagtatatgtaggtaacatgctcagcttcaatgaagctcctttctaaaaaagattttgtttaaactaaaaagaaagcgggtatatctaaagtgtgaaattagaacatccataaggagcaaatcaatgaactggtatgagaagcttagcgagtatttccctattgaagaaatgaaatcaaaagagcatatggaagcattgttaaaggaacaaaacgatatttaccataaagaagaaggccgtcatcatgtgttgatgtacgccgaattcgactcttttattttcatcgactatttattcgtttctaaagacgcacgaggacagggacttggatccaagctgattgagaagctgaaaaagaaaaacaaaccgatcctactcgaagttgagcccgtggatgaagatgatgccgatacggcgaaacgtcttaaattttatcaaaaggaaaactttaaacacgctgagtcgattggttaccgccgccggtcactcgcaaccggcaaagtgaacaaaatggagattctgtattggtctccaaaatcaaacacagagaaagaagtgtttgacgcgatgaaagaaacgtacgaaaaaatccatacatacaaagatgaaaaatggtatggagaatcttatgaagatgtggatgacgtccttacgattgttgacgatcataaacagaagaacattttcgatgaattaagctaaatgagaataagacctggcataaaaaagcaaaagtcactggattgtcaaaaaatttctgttacagactgttcacacttacttttttatagtataatactcaataaagattacttttttagagttatttcaatttaagaatacgctaatttcattctactttttaaggagtgaagcaatatggttacattatatacatccccaagctgcacgtcttgcagaaaggcgcgcgcatggctagaagaacatgatattccgtttacggaaagaaatattttttcagagcctttatcaattgatgaaataaaagagattttacgaatgacggaggacggaacagacgaaattatttcaactcgttccaaagtgttccaaaagctgaacgtcaaccttgaaacaatgccgcttcaagagctgtaccagctcatcaatgaacatccgggccttttgcgccgtccgatcatcattgacgaaaagcgcctgcaggttggatacaacgaagacgaaatccgccgcttcctgccgcgcaaagtgcgcacattccagcttcgtgaagcgcagcgtcttgcaaactaaaagaaggctgaatttttcagccttcttttagttgtagacaaaatcgtttagattttgtcaacttttgattcagcgtgatccgaaaacctttgcagtctaggaaggccgagcatcggagcgcagcgaatgttggaattcgtgagcaccgacgcgcaggccctgacaacgaatgcgagggtttgtcggcacgctgagaaggctgaatttttcagccttctttttttaatgcttttcactcgtctgttcataataaatactggctaaaatcacaaaaataaccgtaaggacgggcagcagcatttcgagggtgctgtgctgcgccataaaggaagacaactcctgctccctgacgatcatttcgccgccagtataagccagcagtccgcttcctgcgtatattaagagcggaaatttggcaagagccgcttgaatcagcctgctgccccaaatgatgaccggaacggagaccatcaggccgacaacgacaagcatcaggcgtccgtgtgaggctccggcgaccgcaatcacattatcaagggacatgaacaagtcggcaatcacgatgatgcggatcgccttaaataaagatgtcccgcctttgacatgctgggcatcttttttctcaatcagaagctgatatcctaagtacaaaaggaagattcctccgataaattgcagataaggaaccgcgagcaggtatactgctgccatggttagcgcgattctcatcatgatggcgatcaatgtgccgatgatgatcgctttttgcctttgccggggaggcaaatgacggcttgccattgcaatcacaacagcgttgtcgccgccaagtatgagatcgattccgatgatcacaaggaacgacatcagtatatcgtgttccatccactggcacctcgctttgcctttgcatcgggacttgctaaaaaggcccccgcattaatagctgctgcttgtacaactaatatatgaagcgggccggaaaatatgttagcttgaccttggaggcgtttttatttcttttccgccttttttatcataaaatagaaaataaagattgatcagggataaggttaagaagtggacgtaatgggtaaagtgtagtaaagtacaattaattgggagcttagttatcccttcaacatcttacaaagaagggaaggttggcaaatggaaatcgaaagaataaacgaacacacggttaagttttatatttcctacggtgatatcgaagaccgcgggtttgacagagaagaaatttggtacaatcgagaacgcagtgaagagcttttttgggaaatgatggacgaagtgcacgaagaagaagagtttgccgttgaaggccccctttggattcaagtgcaggcccttgacaagggattggaaatcattgtgacaagagctcagttgtccaaagacggacaaaagctggaactgccgattcctgaagataaaaaacagcatgtagcagaagaaagccttgatgctttgcttgacgactttcaaaaagaagagcaggcagaagagcagaaactgcagtttgttttaaaatttgacgattttgaggatttaatctcactgtcaaaaatgtctgtcagcggttgccaaacgacattgtactctcatgaaaaccgctattatttattcgtggatttcaatgaactgcctgatgaagaggtggaaaaccagctgagcattctgctggaatatgcttcagaatcaaagatgacgattcatatgctgaaagagtatggaaaactgattgcagcggatcatgctcttcatacaataaaaaagcactttgcataaaaaagccggtttcctttgaagccggctttaaccttctccgttacggggaaggtttttttgtgaactttatgaacaaaaagaatattatgcagttaaactgtgcaggaaaagacgaggaagctataatgaaagcgattacaataaagggggagcacaacatgacaaagaggggcagatgttacggctttacgattttacttgtgtttgcgctgattttgggaggatgcggcggaaacacggcttcaaataaagccgcgaatgaaaaagactttaagccttcgaaagcaatcgaggtcgtcgcgcctgccggagccggcgggggatgggatacaacggccagaacgatctcgaaaatcatgggtgaagaaaaattgattgaaaagatggctgtcgtcaacaaaccgggcggcggtggagcgtccggatggtcgtatgtccaccgcaaaaaaggcgataatcatacgttgtttgttacatcaccgccgattttgttcgtgcctttaaacggacaatcccagtacggccacaatgattttacgccgattgcaagcgtgattgccgattacggagcgtttgtcgttcataaagattcgccttatcagtcgatgacagaccttgtggatgcgcttaaaaaagatccgaaagcagcttctattgtagggacgtcttctcctggaagcatggaccacatgcagtttgtcagcgctgttcaaaaggcgggcgttgatgcgaaaaagctgaaatatattacggctcaagacggcgcagggatgagcatgctgctcggcaaaaaagccgacgtctactcgacgggtgtcggtgaagcggccgaacaagcgcgagccggaaaagtcagagtgctggccatcaccgctcccgaacgcatgaaaggagataccgtcaaggatttcccgactttaaaagagcagggaatcgatgatgaatttacggtttggagaggatttatgggacctccgggaatgagtaagtccgccgtaaagtattatgaggaaaaaatcaaagagatgatggaaaaagacagctggaaatcgattcgggacagctatggatggacggataactttatgggccatcaagaatttaaggactatcttgacactcaatataaagaaatgaaagcgctccttgatgagattggattgggcgacaaataaaacggtctccgcgcgcggggttgccggtacgcagagcctaaaagccccgcccggcacagcccgcgaccggcatgctgaaatcgagaaaggctggtgtaaaccatgagaatcacaaaccgggccgtttctgtcatcattttggctgtagcagccatttacctggcgctcagctttaatttagacagctatccgtacgcggtgatcgatgcggatgtgctgccgaaaagtttaggcatattgcttctcatattaggcatatttctgttttttgaaaaagatcaaaaggatacaacggtgaaaaagctgtttcagctgcagaaaaaagacgttaaggtcatgatgctttgtgttgtttctctgttgatctacatttccgttttagaattcatcggatttttgctatctactgtgatgctgctgctcgttttgcccgcggtgttgggatatcggaactggaaaactgctgcgatcgtttccctggttttcagcagcacaatttatttttcattcaattatgtactcaacatcatgcttccgcagggggttatgcctttttaatcgaacataaggagggaagtgaatgttagatagtattttatacgggtttcaggtggcgctgactccgcagaatatcatgttcgcttttatcggagtgctgatcgggacgattatcgggatgctgcccgggctcgggccgatcaccgcgattgccattatgatcccattaagctatggaatggatccggcctccgcgttaattttgatggcgggtgtctattacggagcggtctttggcggttcaacatcatcgattctgttaaatgcccccggagtggcaggcactgtcgcgacatcgtttgacggctatccgatggcaaagcaggggaaagcggggaaagcccttgccatcgctgcaatttgctcctttgcaggcggaacgatcaccgtagttgcgctgatgctcgtcgcgccgacaatggcaaacattgcggtgacatttgggccgacagaatattttgcattgatgatgctcggcttggtggcaatttcgagcctttccgaaggatcgacggtcaaagcgctgatctctgcgacattgggctttatgacggctaccatcgggattgatccgcagacggggaccgaacggtttacattcggtgcggcaagccttctggaaggaatcgattttctgatcgtggcgctcggtttgtttgcacttgctgaagttgcgtttttaatcaagacgcggaacaagccgatgacagagggagcgtctcaggtcggcagcctgaaggtgacgaaaagcgaaatgaaagagatttcgggaccgatcgcaaggcattcggtcatcggatttctgctcggcatcctgcctggtgcaggagcgacgattgcatcatttatttcttatattacggagaaaagaatctcaaaacatcccgaaacgtttggcaagggaaatattaaaggagtcgcagctcctgagacttcgaacaatgcggcaacgagcggcgcattcgtacctctcctgacactcgggattcccggatcagggacaacggccgtcctgctcggcgcacttttggtcgtcggcgttcagccggggccgctcatgcttacggatcatcccgacgtgttctggggcgtgatcgcaagcatgtatatcggcaatttatttctgctgattttaaatttgccgttaattcctttcttgtcaaaaattcttctgattccgaagcagcttttgatttcgctcatatttgttttctgcctgatcggcgtctacgctgtgacatttaatgtcgtacacctttatattctcgtgttcttcggaattctcggatattttatgagagtgctgtcttttccagcggctccgtttattttggcttttattctcggaagtttgatggaagagtcgttcagacaagcgatgacactgtcatcaggaagcctgtccgtgttttttgaaagtcccgtcacaatcggtttattgattacggctctattgtctctcatcgtgccgccgatttcccgggcaatgaagaacagaaataaaaagtcgatcgatttggaaggctaagctgtcgatgtccggaacgctacgtttccggactttcattttttacgggcttgtagcgccgttcgggccgcccgacggttccatagtaaagttctgtttttacatgcttttcggcagctaaaaattctaaatagcgccttgcggtcgtccggctgacaccgatggtgcgcccgaggctttcggcggtgatgccatcgctgttttcgcttttgtttaaaacgccggctacttttttcagcgtcagtccgtcgattcctttcggataatcggctttagcaatttgttctttcgtgatgctccgcctttttgccatcaggctgtcaacgtctgtctggtcgattgaagacatttcatttactttgagccggtaagaccgatagtttaacagcgtttctttcagcctggaaaacataatcggcttgatcaaataatcgacggctcccgcgcgaatcgcctgttcaacatattcgacttccttagccgccgtaatcatcatgacgtctgtatgcctgagcgtttgtctgatcagccagagaagctccatgccggagccgtccggcagaaaaatgtcgagcaggacaaggtcgggcttcacgtccggaagcaaatcttttgcatcttgaaaattttccgcgattccaatgacagaaaatccatcaattttgctgatcagtttttggtggatgtcagcgtttctgatgtcatcctctacgataaatacttgtaatgctttcataggtcagtcccccagcgtttctctattttggtatcacgacagtaaacaatgctccgccaaggtcgcttttgtccgctttaatttgcccgtttaacgcattgacggcttctttaactaaaaagaggccgaggccgcggtggtttgccgtttttgtcgaataaaacttttgaaagatccgctcctgttccccctcgggaataccgtctcccgagtcttcgacttcaattaatatgtgatctgcaccgtctgacaaatgctgcggtcttttttgtgggaaacggcgtcaaaggcattctcaatcaaatttcctaaaatcgtaatgaattttcccttatccatttcgtccggcaaagcgttcaattttgagctttcatcaatttccaggttgatgtgcagctctttggcacggttgaccttacccagcagcaacccggaaagaagcggatctggaatcgaatggatgagaaattgcagcatatcctgatggcttttattctctttttggatcaactcgagtgcttcaggatagctttccagctgaatcagtcccgcgattgtattcagcttgtttgaatattcgtgggtctgggctctcagaccttccgcgtattgcgaagtttgcgccagctttttggagagttcgtcaatatccgtctttctcctgaagctcgcaacggcgccgcggattttttcgttttcgaaaatcggcactctgttgacgattaattcttcgtttccgatcgttaattcctgatctttttgcgccgttttcgttttcagcacttcggggagcagcgtatccggaagaagctcggaaatcggtttgccgagccactgatcttcgctttcgacacgaagcagctcacacgcttttctattcaaaagcgtgatttcttcatgtttattgatggcgatcaaggcctcgtgcacagattctgtaatcgcctgcttttcagtatataattgattaatttcataaggctcaaggccgaaaatggactttttgacattgcgggaaatatagacggctcccaaaatccccatcagcacgacaaatcccaataaaaatatgaattttgactgatattgatagacgatgtcctgaatattttctattaaaaaaccgactgagatgatgccgacgatttcgccgttttcattatggatcggcgctttgcccctgatggccgggccaagcgtgccgacggcttccgaaacgtatgcttcacctttttcaagggcgcgccgattgtctccgccgaccattggtttgccgatttttccagggtccggatgagcatagcgaatcgcatccgccgagccgatcacgatgtattgcgcaccggactgttttctcgcattttctgcaattggctgaagggttcgagacggatcgtccgtttcaaacgctttctgaacggaaggcatgtgggcgagcgttttcgccatatcgagcgctctggcctggatttgtgtttttaaagaattttctaaaataattaaatagaggccgctcatgacagaaagcaagagcaaaagcagggtaagaatcagcaatgtgagcttggtggtcagcttccgtttgatgtcaaaaactccttttctcaaaatttcgagttctataatactactttatataaaatcggcctggatttgaagcgttttcaaataaaggaaagctcccgccaatgttgaatactagatcaaacaggaaggagagataatatgttcagtgcaatgatcgatcaaggcgggaccatctgccttgccgacggatacaaagccgaagatctcaagcgattgagaaaaagacatgcattttactgcccggtgtgccggtgtgaactcgacctgaaaatcggttccgtcaagcttccgcatttcgctcataagccggatgcagcatgtccggtgccccatgaaccggagagcccctatcacctgaaaggaaagcggctgttgtacgaatggcttggcagacaaggactccgcccggtgcttgaaccgtatttgcaagagatcagacaaaggcccgatttgctgctggaacacagaacccgccaggttgcggttgaatttcaatgtgcgaatctcaatgccgcagcgtatcgcaaaaggaccgaaggctttctcagactgggaatcgagcccgtatggattctcggcggaaaccggataaaacgcttgacgggggatttatttcagctttcgcggtttcactggcagttcattcagaaaagcgacaagcccccaaagctcctgtttttttgccccgaacaaaaggctttcatcatcctcgaacacctcattccctttcaaacaaacaaaacatccgcatccttgcgctttcttcctcttgctgaagcaagctggcgtaatgtaacagaacgagaaagccgttcgcctctccagctcaaaggctggaaaaagaacatcctcagctttcggatgtcggccgtgcgttttttatcaaaagaaacgaagcagattgccgccctcttttatgaaaatcatcagcttccgctcccgttttttccctcagaagcctttctcccggtgccgtcaggctatatttttgcccacccggtttatgtatggcaagggtacctttttttatttataacgaagcatgatacatttcgcctgcagtctgcgcttcactatatggactggctcatcaagggcaaaaggctgaagctgagatggagcgggcggcaaacggctgcggatgccgtcggtgaatacatttgttttttgcataaaaaaggatttttggtgaggaaagaggaattttattattccgcgggttcttttgttccggagccgcggttagaggcgctgttaaaaagggatgaacattatttttccgaatgattatcaagcctttcgttcaatctaaagaaaggaaggtggtgtccggactgtttcagatcaaaagatatgtattttattttttaacggcgggattttgtgtcttttttttcgcatatgatttgacaaaagacggtgaaaaaacagaagataaacacaatacaagtttattggataacaatggacttggagtaaagaaagcgaggggattgacagtggctgaagaaaaaaaatcgaagaaactgccttcaagagaagaggtgaagcaagaagacacgtggagactggaggatatcttcccgtcagatgacgcttggaacgaggaatttcaagccgttaaagaactgctgcccaagctttccgaattcaagggcaagctcggccattccgccgatgatttatatgaagcgctgacttatcaggataaggtgatggagcgtctcgggaagctgtatacttacgctcatatgcgctatgatcaggatacgggaaattctttttaccaaggtctcaatgataaagcggcgaacctctatactcaggctgcgagcgccacggcctacatggtgccggaaatattatcgattcaggaagaaaagcttcagcagttcctgttggaaaaagaggaattaaagctttactcacacgctctcgaagaaatcaataaagagcgccctcatgtgcttagcgaggaagaggaagggattttggccgaagcgtctgatgttctttcatctccttccaatacattcggcatgctgaataacgccgatatggaatttccggagatcaccgatgaaaacggagaaaaggtgcagctcacacacggcaattatatcacctttttggaaagcgagaaccgcgatgtccgccgcgcggcattcaaggccgtttatgaaacatacggccgctttaaaaacacgctagcttccacgctcagcggagctgtgaaaaaagacaacttttatgcgaaggttaaacattataaatcggcgcgggaagctgccttgtcgcgcaacagcattcctgaagaagtctacgacaatcttgtcagcacgatcaacaagcatctcccgcttcttcaccgctatgttgagattagaaaaaaagtgcttgagcttgatgaagtgcacatgtatgacctgtatacccctctggtcaaggattctggaatgaaagtcacttacgagcaggcaaaggactatatgctgaagggtctggcgcctttgggggaagaatattcatccatcctgaaagaaggattgaacaaccgctgggtcgatgtgtatgaaaacaaaggaaaacgaagcggcgcctattcttcaggaacttacggaaccaatccgtatattttgatgaactggcaggacaacgtcaacaatctgtttacgctcgtccatgaattcggccattccgtgcacagctactatacgagaaaatatcagccttacccgtacggtaactacagcattttcgtagccgaagttgcttctacgacgaatgaagcgctgttgggagaatacctgctgaatacaatcgaagatgaaaaacagcggctctatattttgaatcatatgctcgaaggctttaaaggaacggttttcagacagacgatgtttgccgaatttgaacatgagatccatgtcaaagcccaggaaggggaaccgctgacacctgagctgttaacgagcatatactatgatttgaataagaaatatttcggagacaatattgagattgataaggaaatcggtcttgagtggtcaagaattccgcatttctattacaattattatgtatatcagtatgcgacaggcttcagtgcagctcaggcgctcagccagcagattttaaaagaaggcaaatcggctgttgaccgctatattgagttcttgaaagctggaagctcggattatccgattgaagtgctgaaaaaagccggcgtcgatatgacgtcttcagagccgatcgaagctgcgtgcaaaaagtttgaagagcagctgaatgaaatggaagaactcctgcaaaaagtcaatcattcataaaaggcgtatgcatgaaagaggctgccggtctaccggcagccttgttcgcgatgatgtcaaaaacctttaaacgttttgcggtggttgaggcggctgatcgtaaaaaggattgatataaataataggggagacgtaatataaaggggtagcatattcatcaaacctaaaatattcaagacgaaaaaaaataaaattgatgcaagtcccaaaatgatctgaagcataaaaaccctcctaaggactgataaaatattaagggggcgacgaagcgcaataagaccggcaaaaccgggcgccagtccgcataattcggggtttggcagcgtgcgtcgggctcgttttctttgttactttgatcatatgatggacatctattatttatgtttttgtgacaaaaatgtgaaaactaatgaaatcagttgtcaaaactcgacatgatttgatattataaagatgtgaaattgatcacaaacaaacatttacccctttgtttgaccgtgaaaaatttctcccatcccctttgttgtcgttaagacataatagaaaccgcgcttatcccggcgcggtttcttactgctttaaagaggaacgtgtgttcgttttttgtgcgataaaaaacacgggagaaacccgtgctatttttcgcattgatagagcggaccggcatcgtgatgttcatttatatagcgccagaacatgccgtgtttcgcttccactctttcgactttgcgggcgaacgcgagctttttcatttcccgttccacctgttcaagcgtccagtcgtaaacgacggcaatctctttgtcggctacaaattgaaagtattcgataaaaagttcgagcggaggtgtttgtgaaggcttcggctcatcgccaagcatttcaaacaatacttcttcgtaaatttcatatgaataatttccggttacctttaagccttctccttcgcggaggctgttgaaaaacgtaagagtcggaacagatgccacttccatttcggcagcgatttttaaatcgcattgcagggctttcacggcgctctgcgaatgaagatcccttttgaattcctccaaatcgagctgcgtgtgctctgcaatcgctaaaagcacctgttcttcagtgatatcctgctgattgagaaacaagctttcctgcatgcatctcaaaaactgcagccctgcttttctgccttgcagttccgctgctttcaaagcgagcgaggcaaggtaaggtgcagagagtgctttgtcgtgcaggagcgttccgtcgcaagacatgcccgacctgcatgcgatcttttcccatgcctctgcgagccggcgctttttgcgtttctgaacgttcagcgctgtaatgctgcatgcggcgatgatccttagtgtgaaaaagcggccgtagcggattttcaactttttgatcgccggctccaatgcccagcattcgggagataaagggtcgacaaacatataaatttccatcggtttttgcggatgtccgtggcaatgggagaaaaattggtcacgctgattgagtgtcaatgtgaaccatcctccattttcggctgatttaccatatgtctggctgtcaatgtcagcctttcaaaaagaaattccctgatttcgccctttaaaccgacatgatccattgcctctttcatacacgaaagccatgcgtccgcccgttccggtgtgatcggaaacggcaggtgccgcgccctcagcatcgggtgtccgtgttcttctgtataaagcggcggaccgcctaaatattgcgttaaaaattgcttctgctttcttgccgtttccgttaagtcgtccggaaaaatcgggtagagcagcggatgccgctttacacgttcataaaaagtatcaacaagttgcgatagaagctcttctccaatcgcttcataaggtgcgttaaacgattgtcccatgttgactactccttttaatatggctaataggaaaatataccgattcctattgcaaaaaaatatttatcttgtgcatcatttattatttcacgattgtatatacttattttagcaacctcgttccatttctacaaacaaaccgacttctgcctgcgggcgaaaatcgctgttttgtttcaaatatcatatcatattcgcttcttaaatgtgtatttttaataccgggaggatgaaagaggaggtaaatgcaggaaaaaaagccggaaagcgtcctttccggcttaagcgtagtaatttgaggtgattttttttacataattttgcgtttctttaaaagggggaatgcctccgtacttttggacatttcccggtccggcattgtatgccgctaatgcgagcttcacatttccgctgtatttatcgagcatctgctttaagtattttgttccgccttctatattttgaacggggtcaaaagcgttattcacgccgagcgccttcgccgtggacggcatgagctgcatcaggcccatggcgccggccgggctgaccgctttctcttgatagcgtgattcctgcttgacgacggcatgaatcagtttctcatcgaccccgtatttttctgcggcgtttttgatgatctggtcaatgttctgattttggccgccgaaagagacgggtttcgctgcggcagatgggacggccgcaattgcctcaggcttttcagctgccagcggggcctgaagctgagacgctgtcgacacagtcggagcaaccgcgggctgtgaagactccaagccgccgacattgcttaaatattggtttaaaatcgagctgaaatcaaaacccgcatcttcggaaccgctgtctgaagccggataaaacgaccgtatcgcctgaagttccaagagagcggccaaatggttgatgttcattgttttcccaccttattgatctttaagtttttgctcataaaatcggacgattttgtttttggtttcacgctcagggatgccgaacgatttcagcagttcagagaaatcccgttttccgcgttcataatccgtcacttcgaattcgatttcaaagtcttctaccattaagtatcggctgtgatccaaaacaattaagccctgcggcaattttttttctgcacggcttgtcgcaagcgttccgaaaaggatgagctcgtccgcttcaatgccgagacgcttcagacgatcgtataccggcccatgcggaatcatgaacgtttcgatttcaggcttccgggtcagctcctggtgggtttccatcagtccgacaggcgccggttcttttaatgtcaggacaaatcgctgctgcttttcgcgaattcttagggcagctcctttttcttttaaagagaaggaaggcgtatcgtaataatggtttttttgtataacaaattgctcggaggaaaattgataatatgatttgattttctcaaattctttttttgtcagcatatttttaaattcgatttcaagttcctggctcattctttaattttttcatcctctcagctcgtaaaattgcattttccttattatctcttgagaaggaacgtttatcaatattgaagctgatatgataaaatgaatctgtacttttattgtaaaggagagcattatgcagaacagaattgagattacagaagccaatctgcgaaacgaccggctggtgttgaccagcgaaatcaatgacggagcggagcggaagccggccggacgcatgctgacagactccgatcattttgcatttgtatacatacttgaacaggacgaatcctttgaatacgtcattttaaacgaaggcatctggtccgatcttaaagcggcccttgacgccggtcttcctgtgtttttacatatcggaaacacggagctggagcttaacgggttccatgatgagctcggatatttaatagagaatattaaagataatgcaaattatggcgaagaaatggaagagagagtgaaacggatattcctctagaaaaaaaggcgatgaaattgggggaaggtttatggatgaaaaacaatgggagcagtttttagcgccgtaccggcaggctgttgaagagctgaaagtgaagctgaaagggatccggaccctttacgaatacgaggaagagcattcgccgattgaattcgtgacggggcgggtgaagcctgtgccgagtattcttgagaaggccaagcgaaaaaacattcctctgcacaacattgaaagcatgcaagatatagccgggctcagaatcatgtgccaattttttgaggatattcgcattgtcgtcgatatgcttttggcgagaaaggacttcacggtggtggataagcgcgactatatcgcggaacataaagagagcggctaccgctcctaccatctcgtcgtgctgtatcctttgcagacaatcaacggggaaaaacagattttggttgaaattcaaatccggacgctggcgatgaatttttgggcgacgattgagcattctttaaattataaatacagcggcaacattccggaaaaagtaaaattaaggcttcagagagcttcggaagcagcatcaaggctcgatatggaaatgtctgagatcaggggcgagattcaggaggctcaggcggcgttttcacgcaagaaaaaggatgaggatgacggttaggggagtgagatggaatgatgaagtttgcggtatcgtccaaaggaaatgcggtttctgattcattgaaaagcaaaattcagacgtatctgctcgacttcggtctcgaatgcgatgaagaagagccggatatcgtcatttccgtcggcggtgacggaacgctcttatacgcatttcacaaatacagcggccgcctcgacaaaacggcttttgtcggggttcataccgggcatctcggcttttatgccgactgggtcccgagtgagattgaaaagctcgtgatcgcgattgcgaaaacgccgtatcaaattgttgaatatccggttttggaagtcatcgtccgctataatgacggcagcgatgaagcgagatatttggcgctgaacgaatgtacgatcaagagcattgaaggaacgcttgtgacggatgtcgagattaaaggggaactttttgaaacgttccgcggcgacggcctttgtctgtcgactccttccggaagtacggcatataacaaggcgcttggcggtgcgattattcatccgtccatcagggcgatccagctggctgaaatggcgtcgatcaacaaccgggtgtttcggacggtcggatcgccgctcattctgcctgagcatcacacttgtttaattaaaccgataaatgatgtgacgtttcaagtcgcgattgaccacttgacattgctgcataaagacgtcaagtcgattcaatgccgcgtcgcaaacgaaaatatcaggtttgcccgctttcggccgtttccgttttggaaaagggtccaggattcctttatcggaaaaggagaataggaaggtttgctgtgagcgattttttgatgaaacagatcataacagaagaggacagcggggttcttttgaaagaatacgtccagcggctgggcatttcaaaaaggatgctgacggacatcaaattcggaggcggcgatcttttggtaaacggcgggcatgtaacggtcagatacgttcttcaaaaaggggacgagctcgtcattcagtttcctccggaaaaaatgagcgaatctttgcaaccggaagaagtgccgcttcatattttgttcgaagatgaccatgtcctcgtcttaaataaacagccatgcatttcgtcgattccctcgcgtgagcatccatcaggcagtctggcgaacggtctgattcattattaccagcggacgggcgtacacgcgaccgttcacctggtgagcaggcttgaccgcgatacatcgggtgtcatgcttgttgccaagcaccgcttcgcccactcgcttttatcggggctgcaaaaaaagggagccgtcaaacggcaatatcgagcggtcgtccacggtttgatcgcggaagagcagggaacgatcgatgcgccgatcgggagaaaatcatcgagcatcatcgagcgggcggtaatcccggacgggcaaaaagcagtgacgcatttttgggtgaacaggcgtttcagcggcatgacggatgtctctatccgtctggaaaccgggcgaacccatcagatccgcgtccatatgagtcatatcggatatcccttgtgcggtgatacgctgtacgggggaacccgcggcttcatcaatcggcaggcgctccacagtgagaggctgacattttttcatccgttcacaatggaagagctgacgttccaagcgccggtgccgaatgatatgagacagttgatagagagctgaataggctctctatttttatggctccatgcggaatctagactcatcataaggcaaagaggagggaacagattcggttgtcagttccgggaatctgaaagcggtcagcctgttgccgaatacacaaccggtatcgatattaattgtatgatgaatcatcctcgggtttttgacgggagtatggccgtatacaacccacggctcgcctctgtaatgagcggcccagtcccgtctcactggccgtccgtctggcagcgtttcccctgtaatatctccgtagagcacaaactgttttacttttccgacaggctttttgccgatgtcttccgctttgatgccggcatgtgcaacgacaagttcgccgttatgcaggatctcgtaaagcggagccttttcgtaaaggcgcatgaaaaggtctctgatatccttctgtttttgtttcggaaggtttctgtattcggccgccgtcgtttccagcccgtgctgcagcttcaccggatttcccttgaaaaaacggtacagcttgttgcaatgattgccgggcacatatcgcacagctccatcttcaacggcccgtcctacaaattcaacgacctccagcgattttggccctctgtcagttaaatccccgagaaagacaagtgttctgttctccggatgaacgggaactcctgatgtcagcgagtagccgagtttttcaatcagcgcaatcatttcgtcatagcacccgtgaatatcaccgataacatcgtatttcatgcgttttttcgcctccagtccgtttgtttttcatatgtatatacattgccccaagccgtataaatcaagcttctgcaactttctccggagaaaatcaggcatattacttttttttctgagcgagcattgttaaaatcaatttttacacctgtgggaaaagagtttcgacggttcttttcccacatgaaaatgtcaaaaatatgccccttttatttttaaaaaagggaacgctaatcatacccggaaaccggttttagaggaggtaccagtttatggagcacacatctgtctcatctttagttgtcgtactgattatcgcatttttaacacccatcctgctgcaccgtttcaggttaagcataccggtggttgtcgctgaaatcatcatgggtcttattatcggaaaaagcgggttcgatctggttgcccagcacgatacttggctcgaaactttatcgatgctcggatttatctttttaatgtttttaagcgggcttgaaatcgatttttccgtatttgaaaaaggtaagaaaaagcagctgcttccgagcggaaaggaagcgccgaatacgtttaaaacggcttccgtcatctttattgccgtctttatactatcgctcggcctctcctacagctttgtcatggcaggatttattgacaacgcctttttaatgacgctgatcatttcaacaatttcgcttggggttgtcgttccgacgctgaaggaagagcggctcatgaagacgaatatcggccagattattttgcttgtcgccgtgattgccgatcttgtcacgatgatactgcttgcggtgttcgcctcaatctacggagacgaaaacagcaatatgtggctgctgatgattttatttgccgccggcgttgttttatacattttcggcagggtatttaaaaagcggccttttgtcgaagtgctgtcaaaaggcacgatccagatcggcacaagggcgatatttacgctgatcatcgtactcgtggcgctttccgagtcgctcggtgcagaaaacattctcggcgcgtttttagccggggtgcttgtttcgctgctttcgccgaacaaagagctcgttcagcagcttgattcattcggctacgggttcctcatcccgatcttctttgtcatgacaggcgtcaaattggacatttggtcgctgtttggcaatccgaaaattttagtgatgatcccgcttctgtttgtggctctgttaatcagcaaagtcgttccggtgctgtttttgaaaaagtggtatgacatgaaaaccgtgctggcttccggttttctcctgacttccacgctttctctggtgatcgcggcgacaacgatcggcgagcgcatcggcatcattgacgcgcagatgtccggcgcgctgattttggtggctgtcattacatgcatcatcacaccgaccggctttaaaaaattaatgccgaaaacggaaagcgaaaaagagaaaaagacgatcacctttatcggcgcgaatcaaatgacgctgccggtcacgcttgaactttctccagaagattatcacgtcagaatcctgcatgtccggcaggaaaagaaggaagaaaagctggcggatccggtgtttgacgttgaagttttgccagattatgaatacgaaacgcttcaatcattcggcgttttccaaacggatatactcgtcgtggcgacaggcagcgaagagcgcaatacagggatcgccctttatgcgaaggagcagaaagtcgcgagaattatcgccagcgcagattccccagacgccgaatcgaggctgaaagaaaacggaattgatacattctccattctgctttccacgaaaacgctgctgcgcgcgcttatcgaggcgcctggcgttatgaaacttttgacgaaccaggatgcgtcgctgtatcagatcaatatgagcaatgagcgatttgacggcgtcctgttaagggagtttccgtttacgggagatgtcatcttcgtccggattttccgcggggttgacagcatcgtgccccatggggatacaaggctgcaaatgggtgacaggctgatcgccaccggttcgcgcgaatatattgcggaattgaaaaaaacgcttggagactgatgcttgaccattttgcaattcgtgataagattaaagtataaactgaatgaacaagaaatgttttccactaggggagtccttgataagggctgagataaaagtttgacttttagaccctcataacctgaacaggttcaaacctgcgtagggaagtggcacggtatttgagtatgtatatatgcaaattccaaaccactttccttgcgggaaagtggtttttttatgttcagaatcgaaggaggagccttgaaatgaagttttcagaagaatgccgaaacagcgctgcaacttggtgggaagggagttttgtccatccgtttattcaaggaattggagacggcacacttccggttgaccgatttaaatactatgtcatgcaggattcctactatttgacccactttgccaaagtccaatcctttggagcggcatatgctcacgatctatatacgacaagccggatggccgaacacgcgaaagggacatatgaagccgagatgtcgctccacaggaaattcaccgatctattgggcatcacaaaggaagagctggagtcgtttcagccgtcgccgacagcgtatgcgtacacatcgcatttgtaccgttctgtcgtcagcggcagttttgcggaaatactcgctgctttgcttccttgctattggctctattatgacgtcggcgaaacgctgaaaacgtgcaggcctgacaacgcgatttatcaggaatggatcgcgacatacggaggagactggtttaaaaaatctgtaacggaacagatcaaccgcttcgatgagctggctgaaaacgccgatgagaaaacgcgcgcgaagatgaaggagaatttcgtcatctccagcttctacgaataccggttctgggatatggcctatcaaaaagaaagctggtcaaaaagcggggtggatcagcttgcatctgcacgcgatcaccgatgacaagcactccgtggaagagctttcagcaaaaatcatctcgattcacgatgccgttgactttatccacatcagggaaaggtcaaaaaaagtaagcgaaatatcaagtttgatcgatcgcctggccgaagaaggcgttgataagcgaaagctcatcatcaacgacagggtggatattgctttgtttcatcatattcaccgggttcagctgccttcacacggcttttccgtcaaaagtgtaagaagccgttttccgcatttgaaaatcggaaagtccgtacattcacctgaagaagcggtgcaggctgaaactgaaggtgcagattacgtgctgttcggccacatttttgaaacggactgtaaaaagggccggaaaggaagaggagctctgagcttggcagaagtgaaggcggctgtccgcattccggtcattgcgatcggagggattaccgaacaacgtctggcggaagtcaaaatggcagacggcatcgccgtgatgtcggggatcttttcccatgacagaccgaatgaggcggccgcgcggcttgccagtctcgcgaagggagattcatatgagaaagcgctatgatacgatcgtgatcggcggaggcatcatcgggacttccatcgcttatcatcttgcgaaagcggggaaaaaaacggccgtgtttgaaagcggggaagtcggcaaaaaagcgacgagcgcggctgcgggcatgctcggcgcccatgcggaatgcgataaacccggtacctttttcgaatttgccagagccagtcaaaaagcctataagcgcctgacgggggaattgaaagacataagcggcattgatatcagaaggcatgacggagggatattaaagctggcattttcagaaagcgaccgcgaacacctgatgcaaatgggtgcactggattctgtggaatggcttgaagctgatgaagtatataaattagaaccgaatgccggaaaaggaattctcggcgccaattttatcagggacgacgtccatgtcgaaccggctgcagtgtgcagggcatttgccaggggagcccggatgctcggtgcagatgtcttcgagtatacgcccgttttatcgatagaatccgaagcgggggccgtccgcgtcacgtccgcttccggcacagcggaggcggagcacgctgtcattgcaagcggcgtgtggagcggagctttgtttaaacaaatcggcttagacaaaaggttttaccccgtcaaaggggagtgcctgtccgtatggaatgacggcatctctttgacgagaacgctttaccatgatcattgctacatcgttccgcgccatagcggaaggcttgtcgtcggcgcgacgatgaagcccggggactggaatgagcagccggaacttggcggaatcgaggagttgatccgaaaagccaagtcgatgctccctgggattgaatccatgaaaatcgaccaatgctgggccgggttgcgtcccgaaacaggggatggcaatccgtatatcggaagacatcctgaaaatgaccggattttgtttgctgccggacatttcagaaacggcatcctcctggcacctgcaaccggtgagatgatggcagacatgatcctcggcaatccggtcaaaacagagtggatcgaggcgtttaaagcggagcgaaaggaggctgtgcacaggtgaacattcagctcaacggccggaaaatagagtggagagacgacggcggcacgatttacgatttgctcgagtcctacaatctggaaaatcgtgttgtcgttgttgaaaaaaacaggcagattatcggaaaagaccaatatcaatcagtcaaactggaagaacacgatgtcatcgaaatcgttcattttgtcggagggggataaaccgttatgttaaaaatcgcagatcgtcaattttcatcaagattattgctcggtacagggaagtatccgtcatttgagattcaaaaagaggccgtcagcgcatctgaatcggagatcctgacgtttgccgtcagacggatgaatatttttgaagaatctcagcctaattttttggagcagctcgatttaagccgttatacgcttttgccgaatacggcaggagcaaaaacggctgaggaagccgtccggatcgccaagcttgccaaagcaagcggtctttgcgacatgatcaaagtcgaagtgatcggctgtgaccgttcgcttctgccggacccggtagaaacgctgaaggcgtcagaaaccttgcttgaagaaggcttcattgtactgccgtatacatcggatgatgtcgtcctcgcgagaaaacttgaagagctcggcgtgcacgccattatgcccggggcctctccgatcggttcgggacaaggaatcatcaatccgctcaacctgtcgttcatcattgaacaggctaaggttcccgttatcgtggatgccggaatcggttctccgaaagatgcggcatacgcaatggaactcggtgctgacggggtacttttgaacacggcagtgagcggggcgaaagatccggtccaaatggcgaaggctatgaagcttgccgttgaagcgggcaggctcggatatcttgccggacgaattccggaaaagaactacggcatcgccagcagccctgaagaagggaagttgacgatttgaccggcaggtattcaagacaggagctctttcacccgatcggaccggacggccaggaaaaattaagccgcgcccgcgtcctcgtgatcggtgctggggctttgggcgcggccagcgcagaaatgctggtgagggccggggtcggttcgctgacgatagccgacagagattatgtggaatggagcaatctccagcgccagcagctctatacggaacaggatgtgattgatcatatgccaaaggccgccgccgctgaaaaaaggctgcgcctgatcaacagctctgttcaagtaaccggaatcgtagcggatgttactgcggaaaaagcgctcgagcttgcggaggaagcgtccctgatcgtcgatgcgacggataattttgaaacacggctgatcatgaacgacgcggcggtcaaattaggcatccctttcctgtacggcgcgtgtgtcgcaagctatggcatcacatatagcgtaattccgggaaaaacgccgtgtcttcattgtcttttggggcatttgcctgcgaataccatgacgtgcgacacagcaggggtgatcggtccggtcgtccagcaggttgccgcataccaggtaacagatgccctgaagctgctgaccgggcatgaaccgtcagggatgctccgctcatttgatatttggacaaatgagcggtctgaagtccgggctgacacgcttaaacatgagacatgtccgacgtgcggaaaaggcgagtttccgtttctttcagctgaaaacgaaacaaaagcagccgttctttgcggcagacaaacggttcagatcaggccggccgcggaacagccgctggaactggaatcgcttgctgccaaattaaaaaaagccggtttaaatgtgacgggaaatccttatttagtttcctgccgtgcggaggattttaagttcgtgatttttcgggatggacgtgctttaattcacggaacgaatgacatcaatcgcgcgaaaacgatatatcacaggtggattggctaaaaggccgaagggagtgcaaacatcatgagcatatataaagcattaacaatcgccggatcggattcaggaggcggagccggcattcaagccgacattaaaacatttcaggagcttggcgtcttcggcatgacagttttgacagcagtcactgcgcaaaatacaacaggggttcacggcgtctacccgctttctccggaagcgctcggcgcacagattgatgcagtggcagaagatttaaaacctgacgccgtgaaaacagggatgctgtggagcgcggagatgattgaggtcactgctgaaaaaattgcagcatatgagcttaaacgtgtgatcgtcgatcctgtcatgatcgccaaaggcggcgcttcactattgaatgaggaagctgttgaaacattgaaacggcgccttcttccgcttgcttatgcggtaacgccaaacattcccgaagccgaagtgctgacagggagaagcattcaaacaatggaagaccgcaaaaaagcagctcgtgacttgcatgaaatgggcgtccgcaacattatcatcaagggaggtcatcagcctgaggatggcaaagtaaccgatctcctcttcgacggagagacgttcacagaaaaaaccaattcctatattaagacgaaaaatacccatggaacaggctgtacatttgccgcggctcttacggcgcaatcagcgaaaggaaacgggattcaaggagctttccgcatcgctgaggctttcgtccacgaagcggttgtacacagccttgattttggagccggccacggaccgaccaaccattttgcatatcaaaagttatccaacgcagggttggaactgtagtcccgcaataagaaagaatcaatatcgcggcagagcatcaaaaacggcctctgccgctttttatattctgaaattgtcagcctgctattaattgtgatactatatattatgatcaggtactaataaaatgttaatcattaggaggatttcatacatatgaatttatcactagaaggccggaatatcgtcgtcatgggtgtagcaaataaacgaagcatcgcatggggaatcgcccgctcgcttcacaatgcaggcgcaaggctgatttttacgtatgcgggcgagcggcttgaaaaatcggtcaaggagctggctgattctttggagcgaaacgattcaatcgtacttccttgtgatgtcactaatgaccaggaaattgaagcatgcttcgccgacatcaaaaaagaagtcggggtcatccacggcattgcacactgcatcgctttcgccaacaaagaagacttggctggcgaatacttaaatactacccgcgacggttttctgctcgcacacaatatcagctcctactctctgacagcggtcgctaaagcggcgcgcggcatcatgactgaaggcggaagcatcgtcacgctgacataccttggcggcgagcgcgttgtatccaactacaatgtcatgggtgttgcgaaagcatcgcttgatgccagcgtcaaatacttggcgagcgatctcggaaaagacggaatccgcgtcaacagcatttccgcagggccgatccggacattgtccgcaaaaggaatcagcgacttcaactcgattttaaaagaaatcgaagagcgcgcgccgcttcgccgcacaacgactccggaagaagtcggcgacacggctgctttcctgttcagcgacctttcccgcggcatgaccggcgaaaacctgcatgttgattcaggctaccatatcatcgcgcgataaaatagcgctaaaaaagcaatccgctaaaggattgctttttcttttcttctgatttctccttttttgcatatagatataccatgaacagatcggagggatcaagatgtctagcagaaaacacgatgcggagcaaaagccgctcatgtatattgtgcagccggactatgataaggcagaggcgaacatgcaggatattctgattaaaagaaagaagaaagcaaagcccgaagcttccgaacaaaaagcgcggcggaaggaacagcaggatgaagccgtccggcccgacgaaaaagacggagctgaagcggtgtttaacgatgaggcgaatcgatccgaaaaaggagtcaaaccgattaaaaagccgctcagcaagatgacgattgccgagaaaatcgactttttggcaagccttcccggcaatatgccgaaaaccctttgtctcattgaagcagacgggaagacatacaggggaacgatcgtcggaaagaagggcgattccgtctttgtcagaacgtcgagcaaaggggctccggcggaactgccgatcgagagcattacctccttgcacccgctcggcttttaaatacacaagataaaaaaagtcccgattcagggactttttaatttgaacgattgatcagttttggatttaagcattcgatcgcacagaagcattccagatcgacttcaatgcagaaacttgttttttccaagcggaacacatcgcaaattttgtctttatcttctgtgaaatcgagaacgcggcgattatcatcaaaggcaatcaacagtctcaatgtagcgcagcagtcatcaatgttttcaactctgaaaaacacggtgctgaagcaaggacctgcctgaagttctccgacatttccaaacgctacgaacggcttagacttagaagtgtataaaataaacggaatggtgtcgcctaagtgtctcgaaggggaaagcaggttgctgaagcagcttgtcgggcagccttcttcctcaatggcgttttgcagatcgtgaatgttttcaacggcttcgcacacgcaattttcggctgaacatttcgtcatgttatgatccctcctagttcaggatttaaaatttcgtttttcggcctggcctttctattggtaaaaggagctgccgaaagccggcagctttcgtgaaaagactggcatcaagccgatcatatcggccggcttgatgcagcctgacaccttttaaccgtggtggtgattgtgttttttgtctgctgcgcgatcaactaggtcaggtgacagacattgaatcgcacagaaacaagtcaagtcaacctcgatgcaaaagtccgtcttttcaagcccgaaaaagtcagggtcacaaggatggcagacgcttaatgtgtcgccgtttatgtccacaggcctcaggattgaaagcgttgcacagcaatctttgagactttctgcccggaagaaaatcgattcgaagcactgcatatcatctgaaaatccgccgacatttccaaatgttgaaaacagtccgccttttttgtcgtacaaaaggaacggaatcgtgtctttaccggaaaccgtcggactcagcaggttgccaaagcagcttgtcgagcacgctgttgtttcctcaacggcatcctgttcttttataatctgttctactgcatcgcatacacaattttcatgccggccatggtgttttccgcagctcatggatttcagctcctttttatagggatatttgactttagtctttaacaacatatgtacccgtgcccttgttggtgtgggtaatcgtctataaaaatgaagaaaagcagagctggttggctctgctttttgaattatagaaggccgacgataagggcggtgatggtgattacaacagtttgaacaaatgtgcttacgatgatagctgtgtctgtatcttcggttgtgacatgtacatttctggaattatcgatcaccaatttttgtctgttcgtttgtttattggcagttacctgcaacagatcagttgtgacaagttcggctagatcaggatcatcgataatggcgagaataatagtaacagctagtgtttgtgcagctgtcatgactgatgccaacgtttgtgtgtcttcagttgagacttgaacatcacaagagtctttaatgatgatcgtttcatctgagagctgtttgttaagatgaagttgatctaggtcagaatcgataaagccattttgccctttcctaccacagttgcaagtatagtcgtcacataattttttcttaggataactagggtgataatcgttgcctggatgttcgcattccgggtcaagcgcaatccatgaatatggtcttgtttccatttcttttcctccttccatttactattattaaatgttgtaactccttaacttgtataagacagataccctactacaaatccccatttttttctgctgaagtatctgactcggttgaattttccgctgttgctgtgttttcttgctccctccgttgtcgaagtttttctctcagtctatttgttctgtttcttcttcttcttggtctctcgccattttctgatgacgcatcagcgttcttttctctctttgtccctttttcattcggtgcggctgctttttctttctgtttttgaaccaaagcatcggtttgtttttttagatcttccagcatattgaaaatattttctttttcttcttctgagagcgtccgaactttatcgctggttactccccgatttttcaagatatttttaacaactgatttcattatcggatctacgttctcttgaagtttttcaaaatctgccaattgtttctcacctcaatttctttaaaaatattagaaagaaaggaaggcttaaagtatgtcaagctctgtgataagcgcgatcagcacttcggttaaaacttggacggaaagcaggatctccagcgaggaaagcgtaatggtgacattgcggctgccgatgactttgatgatgactcttctcctgctttgcagcctgtgtacggctaaaaggtgttctgagacaatgtctgctgtatcctcgtcttcgatcgcaagctgagccgataaaatcgtcaaagagatcacgatggcttgtaaagagagagctgctgttatgtttgccgtgtttaccgtgacatgttctgaatcaattacttcaatgagctggtcatattcccggtgtaattcgtcaaatgtttctgcgtacagcgcttcggctttttcatgaaacgacataactttcactcctttcttatccacactttattaaatgcagaccggtaccatagcggaatgagaaaaacatacatttcagcacccaaatttgctgttttagggaaggcggttccggcatatatttggaaacaggaagggggagccctgtgatacaaagctggtttttattttttttattttctatcgcggtatttcggctgacgaggctgattgtgttcgacacgatcatggcgccgtttagaagcctgtttcatgaagaggttgaagaaaaaaacgaaaaaacgggagagaccgaaacgtatcttgtcatgaaaggaaaaggcgtgagagcgtgggtcggcgagctgctgagctgctattggtgcacgggcgtgtggtgtaccgcgtttttgcttgttttttacgcatttgttccggtcattgctgaatggctgattcttctgctttcgatcgccggcctggctggagtattggaaacgatcgtttccaaatggctcgattgaatggggatttgtcattagcaacttatgaaaagaagactcatataatggcgtataagcatgagaaaggaaggaatgcaatgagacaagtgaaaagaaggcagcaaggccgattaacgaacgcttccagcaatcatcagtccactttctcaaaaaaagtgaagaaaaaaggctgcggatgcggcaaaaaaaagagaacctattaatatcaaaaaaagccggaatgcatccggtttttttgttgccaatttttcttctggtgcatacaccatcataaggaggggaagcgatgaatttatttgaacagctggttgaatcgatataccgcaaacatgatcaaactcaagccggccatgacaaggtgctctttgaacagcagaaggaactggagacatttgaccgctcggccgaacagttcggcaggcagatcgaagcgtttgcggagaatgccgaaaaatggctgggagaggacgggagtctgccaggcatttttaaataatccacagaagccctatgcatcaatccaagccaatcctatcaactgtcatatcgtgtagggagaaaaggaggtgctttagatgggcttttgttgcggaggctacggcggtggctacagcggcggctatggttcaacgtttgtattgatcgttgtcttgtttattcttttaattattgtcggcgcttcttttaaatattagtttttgagttgaagcgaagagggcggcggcagcatatgtgccgggctctcttctttttgagcgggaaaagcacaaggcttttcaaacatgcataagatagcgtatcactcccaaaaaggaggcataggtatggacaatcaatttttcaaaaacatcgaaaagaaaacgggcgtcagcatgaatgacgtcatgcagctcgcaaattcgctgcaaaatgccaacttcaaggatgaaaatacggtccgcagcgtgattaagcgcgtcgctaaattggcgaataaacgggttccgaaggaaatggaagataagattgttgaatccattgtaagcggcaaagaaaaaatggatttcaacacgatcgcgaaaatgatgaacagcaaaaaataaacaccgcgccttccgataaaaggagggcacggtgtcttttattgcagctgaacttgtggattcgggcgtaaaataggctgtaaaaaccttgagcggtatgccgttcttccccttctgaaggaagggacgctgatatacaggcggtcctcggcccgggtcatggcgacatacagcagcctccgctcttcttcaagagcggtttcatcgccttttctcgctgtctccagggcaaagtcatgcggaatcgagccgtcctgcactcccagtatatagaccgttttaaattcaagccctttcgcacgatgaattgtcaaaagctgaacaccgtatccgtcagctttttgcttttccgcggctctcatatgatcgacatgctcaagaaattcggggatcgttttgaatttttttgccgcagttttgagatcccgcagatcgtcagaccctttttcgagcttgttcccttcgtttccgcgctttttcaggtaatcggaaaagcccatcttttcttctgcgaaagagatggcttcaaccggcttcatcgtttttaagcctgggaaaaaaggaacgattttttttattttatcaagctgaaacggtttaatgtcagtcaatttttcaagcgcctgaaccattgtgcaatcttctgtaatcgagagcgctttaagcgtgtttaaagcggactgcttgagaaagagggcgggtaaaatctgctttacggcttccgcgtcatcttgattttggcttaagtagagataggccagcatctgccggacgatcctcctgctgtaaaacgaccggacgccttgttcagccgtgtacggaatggctgactggtgcagacgttcaaaaatggcgcggccgctgctgtttgtccggtataggatggcgaagtcatcaggctttgcgcccatttcaattttttcttggatatcagagacgatcataatcgcttcttcctcttcatcataaggataaaataagagcggtttttggcggtcgtctctcgcggcgcttaatgttttcggaaaacgctttttgtttttccttacgaccatatcggcgcttgccacaatcggatggctcgatctgtaattcgtcgtgaggcggaccgttttcgccttcggataatctttttcaaaatcgagtataaaagaaggactgctccctctgaacgcgtagattgactgatcatcatccccgacacaggtcaggttgttttcggggcttgccaagagcttgatgatggcgtattgaacagggttaatgtcctgaaattcgtcaatcaaaatcgcgtgaaagcgcgtctgatatcgctttaaaatgtccggctgttcttgaaacagctgccagcacgcagatgccatatcgtcgaaatcgaattggcgccgcgctgctttttgttcttcataatgacggtacagccggtgaacccgcttttcccattcgtcttcaagcggaatctgttcacccggaagataagcgttcttccagtagccgatctgctggatcgcctggtcaaccggaaagtctttttcatcaagcccttcttcggcaagggccattttgatgtactgttctttttgccattcccatttcagcaggtgctcgccattccatttggccggatcatgatgataaagaattttgtaaaaaaagctgtggaaggtgcctgtcacgaggcggttcacagtctgcatcggcaaaccgtatagcgaggccatccgctctttcatttctttcacagcttttgtcgtgaatgtgacgagcaatatggcagaaggcgggatatcgagccgggatatcatataagccgctcgcgcggttaatacccgcgtttttccgcttcccgcgccggccagaacgagaaggggttcttcgggggccgtcacggcggcaagctgtttctcattcagcggcacattcggaaagaccggttccggagccgtttctgccgctggagagaaaggagaatggatggaagcttcgcgaggcggcgtccagaagtccgtgtccgccttcttttcctctccgatcgctttgcctttcgggaggcggaaaacgccgctttcagtataatcgttctgtttggtcttctgctctgtcttctcatttaagcaagccgcttcacattgagaaaaatccccgttttcccggtggaaaaaatgcggctcttcatgaatcgacaatttcagtctgagcggcaagccgcaatatttacacgtgatcctgtcttttcttgcttcatcaaagaggaattgcaggtgttctctcgaatatgtatgtatatgaatgtctcggttattgaatcgggcgcatttcaaaaagaggtcctccaattaatgggtagtcgtctggtgtcatgagacaacgtctatcatatcaaatgaaaaccgtttaaaacagtagatttttgggaattaaagctgatgaggaggagatcgaatgggatatttgccgcctgtccgcaatgatcaatatatacagtatgccaatcgaagcatcagccaaaaatcgaactacgcttatatacaaaaaaccgccaatatcccaagcgagcgcgcctaccgcgaagtcgaaaaaagagaggaaaatcagactgcggcttttaggcgggtcgaggaaaaaaagcggaaaaaagcgctcaaccgccgtgttgcgaaaaagacggaaagcgggcgcttcgtcaatgaatccgtttgagagatgaaacaaaccccggcttttataccggggttttcgttattttctgcgcagttttttgagtccgaaatacagaatgatcatagccgccgccccgagcatgatcggagtcgtgtacgttcttgctacattttcaacatggtcccaccggctgccgagctgtacgccgagatagacgaacagtatcgaccacggtatgatggccagcacggtcagacccgtgaattttaaaatcggcattttcgcaatgccggccggaatggagatggcgtgtctgaccacgggaatgaagcgggcagaaaagacgacgcctccgccgtatttctcaaaccatttttcggctgtttgaatgtgatgcttttggatcaataagtattttccgtatttgtataaaaacggccgtccgccgtagtagccgatccagtataaaaacaattgagcaatcgttcccccgatgacgccggcaatcacggcgcctgttatcgtaatcgagccgtttgagaccatgtatccgccgtaggcgagtacgatttcactcgggatgatttcgatcattaaaccgatcgcaatgccgaaatagccaagatcggtcagccacattaaaatatcattcactatgcttcccattttcgttttttctccctgcttttgatttcatcagccgaacgttggagcagccgccgggacgcttccctggcgcccgcgggggaaataagcgaatctcaaaaaccgtccggatgcgctttgtgccattgccatgcgctttgaatgatggtttgcaaatcgctgtattgcggcttccatccggtatcttccaccagtgtccggctgtccgccaccagcactggcggatctcccgctctgcgctcgtccgtttttgctgcaatgcttcgctctgtcatgttttccgcggtttcaatgatttcttttacggaatgtccggcccctgtccctacattataaacattttgcttcagtctgtcttcatataatccatcaagggcagccaggtgggcggaagccagatcgaggacgtgaatataatccctgatgcaggttccgtctggcgtcgaataatcttctccgaaaatggacagctgctttcgctgtcccaaagccgtctgcaggacgaggggaatgaggtggctttcgggatcgtggtcctcgccgatcgctccgtttaaagcggcgccggcggcgttgaagtagcggagggcggcccatttgacaccgtgcgtttttccgacccagtgcagatatttttcgatcatcagcttcgattccccgtaaggattgacaggggagaggggagcagcctctttaatcggggctttctccgggatgccgtatacggcggcggttgacgaaaagacgatgttattgacgccttccttgatggccgtttcgaaaaatgcacaagactttagcgtgttttccctaaagtatatctcaggcttttcgatcgattcggacacaaggcttttggcggcgaaatggatgacagcatcgacatcatgatgtttgatgatggctttgacaagtgccgcatcagcgatatcgccttcgtaaaagctgaccccgctgacggcttccctgtgtccggtagataaattgtcaagcacgacgacggagcggttttgctttgtcaattcgagtacggtgtggctgccgatgtatccggctcctcctgttacgagtacggatgtcattgccatgctcctttctgcgcttctttttttaagacgctctccaggtaggcgagcagttttggccgcatctcgtcccgcatgagggcgatttccgtactcgctttaaagctgcccagcttgtcgccgatatcaaagcggcttcctttcaatttgcgcgcatacatgctttgttcccggcagatttcccttagtgcgtcagtcagctgaatttcatttcccgcgccgcgcttcgtttgttcgagcacagggaaaatcgaaggcctcagcacatagcggcccatgaccgcgatatttgaaggcgcatctttgacggtcggcttttctacaagatcgtcgatttgatacactttgttcttttgcgcggatgtctgaatgatgccgtatttgctcacgtccgctggatcgacgggctgaacgccgatcacttcggtctgatattcttcatatacttcgagcagctgcctaagcgccggtgtttctgacaccatgatatcgtcgccgaggaggacggcaaacggctcatcaccgatgaaatgcttggccgataacactgcatgtccgaggccgatgggctccttttgccggatataatgaatattcgccatatcggcgatctcgcgtatctcttttaacacatcgttttttcctttggccagcaggttttgctcaagttccacagagcggtcaaaatggtcttcaatcgaacgcttatttcttcctgtaatgataaggatgtcttcaatgcctgattggacagcttcttccacgatatattgtatggccggtttatcgacaatcggcagcatttctttcggctgcgcttttgttgccggcaaaaatctcgtacctaatccggctgctgggatgactgctttttttactttcatggttattcactcctggtcttttttatgaatctgtgccgggttcttgaaacacccaaagcttgtttccggtaaagttgatggccattcctgcgactgttgcggacatcttgctgataaaaagggacaggccggctttttgaaaaatgtacagaaggacaaatgtagcgcccgctgctgcaagattgatcatgataaaccggacgatttccgcgccatgcgctttttcttttacttgaaacgtccatgtccgattccagatatagctgtttgccacgcctgccgaataggaaaacaactgtgcggccaggtaggggacgtggagcgacgtaaggaggaaaaacacgacgaaatcaacgagtgtgttcccggctccgactgtcccgaaacgaacgagtgtggggatgttttttttgttcataacggcattcggctgttacctcccgtctattttgtgtagggctttgtaaaagcttagaaacaactttaatagacaatgttgaataaacgataaacaaaagatgaacaaactatgaaatgttttctgaggaaaagaaaaaccgttccgcttaaaaagcggaacggttactttttgaccattttgacatggggaatattcgcatctgaaaattcttcagacacgactttatagccgtgtttttcgtaaaagggaacagcctgtgtctgcgcgttcagcataaattgagacgcgccttgcttggcggcttcctcttcaagcgcctgaatgatcaggttgccgacgccgagggagcggtggcttttcagcacacagattcgttcaagtttgccgtagccgtcgacaagccggagccggccagcgccgatcggctctttttcgtcatagatgacgagatgtgaagattcctgatcaagatgatccatttcttcttccggtgatacgtgctgctccttgataaagacttcctttctaacaaagaaggcgtcttcaagctgttgttgattcttcacaatgacggcttccactggctttcttcacgctcctaaaataaaagtttcatagacggtccatgatccgttgtccaattggtaaagcaggtgaaagcggtcgatgacttcttcgtgtgacgcgtctctcattttcagcgtgccgaggacgtcggaatgctcatcatctgacagcttttgtgcgactgtgacatggggaacaaacgcgtattcgggtttgtcttccaaaacgccgctgtacattttttcatgaagctgcatcaattcctctgtcggttcggctttcatgtaaatgacattattgacgggggcaaaggaactgaattttgtaatcttcagcgtgaccggtttcagctcttttgaaagctctctcaagtgtcggacgacgcctgagatctcgtcttcagacacttcaaaaggcgttcttaatgtaaggtggggcggaattaaagcgtaattcgggtcatagcgttttcggtaggaatttgcaatgtcctgaagtttttttgatggaaatagcacaataccgtatttcattttgttccctccttaaacaattgatatggtttagtatatcaaagatgggccgatatacagagagctacagcattttttttaaagcgggggtgatgagcggctgccagtacgtccatttgtgatccccgtcaaaagctttgaaatcgtagtttgtctgctttgattcaagcaactcttttaattgctcatttggacctgtgaaatccaaaatttgatcatcggtcgttttgacggcggtttccttctcgccgatttggtggcaaattgaaataagctgcagggaatcggactgtttcactttatcgagaacatggcggtctacataaggtgactgcataatgacgttcccgaacatattcgggtagtcaagcgccgtcatgagagaaaccgttcctccgagcgaatcccctatcagcgtcctgcctgatccgacttgatatgtcggatactctctgtcggtgaaagggacgagttcatttgccaaaaaacgtttatacgcttcgaattttgacccttccggatggtatgtaagccttctttcctgtacgtttttgtacggaatgccgatgatgatgcttctttcgatttcaccgttcgccaacagttcttcaacctgtctgctgatgcgcccgagccggaaatagtcatgtccatcctgtgcgatgatcacatgatatttgtaaagcggcgagaaggaggacggcaaatagacgagaagctccatttcctcgccgagctcttccgaaaaaagctttttctcctgaatgactcctgttttcatagccaaggtgaattcctccagaaataatgtttgtgaacgtttccattcattgtaacacgaaattctcttgtgaaagaagcgaaaagggctgccgaactgttcggcagccgtgattttttatgatcgttttttttcgtaccaaggcattgtcggtctatcggagggtatccgtatcgctcacggtacctttttctttccgctgtgaaatcccgccggcttttgccgctttcgggattgttggttataatggacgatgcatcgcagcgcatcttcggcacaaggtcttcccagcagcctttcaattttacgaggcggatgatcaaattcatgcttgatgtcgcctgaaggaatgacagcctaagtcaacggcgcactgcaccattttcggtccgatgaaaggtaccgtttgaaaccgggcgggcgctttgatgtatgcggcgcttttcaaagacgaagcgagcgatgtgcaaggaaggacagatcacatatgccgcgtttcttttttttatcagatgcccccttttatagatacaggtcgaacatgttgacgtcatagccgagctgttttaaataattaaacagctgggccctgtgatggaagatgtgggtgagcgtttccgtcagccagcggctttgggtcatcccttcatcgaggtaaaacggctttgttttttttgtcaaaaaatcctcgtcggagagggaagtcatatacgtttgaaaagcgtcgaatcctttctgcatagctgcagccatttggtcagccgactgcaaagcaccatatttcttttcaatccgggcgatgacgtcctcttccttttcctgcatgatggccaagtcggcttctgggatggccgtcagatggcttgccagttctttcaggcttcgcatgcggtcggcgggccggtaagaccagtcagattccttcacttttttcagaagatgacacgtggagcggatgcccgtctccaattcgtggaacaaatcgccgcgcagcgcttgaacttgattcatttgcttcatcctttccatttgcttttattctaaaagtatcacctaatcctgacaggtcttgtcatgattcttaaaaaaagtcagccgtacctcgctaaaatgtcagcagccttccgtttcagatgaagcttgatttccgcgggttctgttacagttacctcagcgccgagattccacaaaagttctccgaaatactcaagttcagacctggggatactggcatcgatcgcccccgttccgtcatcccgcatggtgaggatcttgaataaatccacatcagccgcagcccgcctggctcctctacgtgtcagttccgcttgcagccgcaccggttcagggcactcgctctccgaatgtttgatccagctgagaactgatggatagggaagctggcgggcctgcccgctgtccgctttttccgcacggaggatgcggtcggcgcggaacagtctgaacgcctgccttttaaagcaataggccggacagtaccagaagccgttccagctgtataagccgataggctggatggatctctccgtgcactcgtcagttccgtcataaacgaccgtcaaaacggattgagtgacggctgcgtcaagaagcgtctctaaatgttcggcggcttttgggcgatgcggattccagaacacgattctgtctttcatcgcatcaatccgctcctgtgtttccgggggaaggtggcggtagaacttttttaaaaccatccgcgtttccgcatcaaaggggagcgatccgaagaactgcaaagattgatacgcgaaaaacatagccgccgcctccgattgtgtgaaaaagagcggcggaagcaccggctcattcagcaaataatagcctccgttcgcgcctgtttcagaatagatcggaacgccgagtgcgctgagctcgtccagatcgcggagaaccgtgcggtaggaaactccgaattccaccgcgagctccccggccgtaaattttcgttttgtatgaatggtcatcatcaattcgattaaacgctctgttttgggcatctgattcctccggttccgtcatttggtttcatcataccatgttcaatataaagaaagatttaaaaatgacccttgaaaaatgtcttgaattaggttaaagtaaagaacaatcagaatattgaagagattcttatcacgagaggtggagggactggccctttgaaacctcagcaaccggtctgcactgacgacgtcagtgcaccaaggtgctaaatccagcaagcggatgcttggaagataagaagaagcgaataatcccccttcttcttatgaagaaggggtttttactttttaaaggatggtgtcatatgactgaacatgtacaaacaacgctggcgcaaatcggcaaccgcagtgacgaaataaccggaaccgtcaatcctcccgtttatttctcttctgcgtacaggcacaaaggaatcggggaatccacaggatttgattacattcgcacaaaaaatccgacaagacagcttgtagaagatgcaatcgcgaaactagaagggggaacgcgcggctttgcgttcagttctggtatggctgccattcagacgatcatggctctgtttcaaagcggggatgagctcatcgtttcatccgatttatacgggggaacataccgcctttttgaaaacgaatggaagaaatacggactgcgctttttatacgatgatttttcagacgaagactgtatcaagtcgaaaatcacggacaatacgaaggcactgtttgtagaaacgccgacaaatccgctcatgcaggaagcagacattcaaaaaattgcgcaaatcgccaaagagaacgacttgctgctcattgtcgacaatacgttttatacaccggttctgcaaaggccgattgagctaggcgctgatcttgtcattcacagcgcgacgaagtatttgggcggtcataacgatcttttggcggggcttgtcgtcgcaaaaggcgaagagctgtctgaggaaatgttccagcaccaaaatgccatcggcgcggttttatcgccgttcgattcgtggctcttaatgagagggttgaagacgctcgctcttaggatgagacagcatcaggaaaacgcgcgggagctcgcggcctttttggaagagcaggaggaaattgccgatgttctttatccgggaaaaggcggcatgctgtcattccgcgttcaaaaagaagaatgggtcaatccgtttctaaaaaatctcaagacgatctgtttcgccgaaagcctcggcggagtcgaaagcttcatcacctacccggcgacacagacccacatggatatcccggaagacatccgaattgcaaacggcgtctgcaacaggcttctgcgcttttcagtcggaatcgagcacgtctccgatttgaagcaggatctcaaagctgcactggaaaaagtgaaaggggaggcggttccgcatgagtcatgaaaactggacgcttgaaacaaagcttgttcataaccaaaataaaacggacggagcaaccggagccgtcagcgtgccgatccagcacgcatcaacctttcatcaagattcttttgacaaattcggcgaatatgactacagccggtcaggcacaccgacaaggaaggcgcttgaagacacgatagccgagcttgagggagggacgagaggatttgctttttcatccggcatggctgcgatttcctccgcctttctgcttttgtcaaagggcgatcacgtgctcgtcacaaaagatgtgtacggcggcacttaccggatgattacggaagtgctgagccgctttgggattgaacatactttcgtcgatatgacggatttaaatgaaattgctttaaacataaaggaaaacacaaaagtcatctatcttgaaacaccgtcaaatccgacgctcggcattacggatattagaggggtcgtcaagcttgccaaggcgcacggctgtctgacgttccttgacaacacgttcatgaccccggcgttgcagcgaccgcttgagctcggcgtcgatattgtgcttcacagcgcgacgaagtttttaagcggacacagcgacgtattatcaggccttgccgtcgtgaaagacaaaaagctcggcgaagaactctataagctgcaaaattcgttcggcgctgttctcggcgtccaagactgctggcttgtgctgagagggctgaagacgctccaagtgcggcttgaaaaagcaagcaggacggctcagcagctcgccgaatttttcgaaaaacatccggccgtcaaacaagtgtattatccagggctgtcttcgcatccgggtgcatcgatccacaaacaccaggcgaacggcgcaggtgcggtcctttcttttgaacttgaggatgcggaagcagtcaaacaggttgtggaaaatgtctctctccctgtcttcgccgtcagtcttggagctgtggagtcgatcctttcttatccggcaaaaatgtcgcacgccgccatgccgaaggaggagcgcacaaaacggggcattaccgacggacttctgcgcttgagcgtcggggtcgaaaatgccgatgatttacaggcggactttgcccaagcgttggaagccgtatccggagcgcttgcccgttcataaaagaaggcgcggattcgtcaaggaatccgcgcctttttttgccatttataacagggtggaaaaccatgtgcccaagaaggtgccgacataattgccgatcagatatccgaacgtcccgaccagcattacgggagcaacgaggccccgccagcctttggcaatcgccatcgccgccgctgtcgtcggtccgccgacagatgcgttgcaagccaagagaatttcatcgagccgaaaacgaaacagctttccgcagaagagcgatacgagcaggttggacatggcaatcacaaagacaaatgccaggaggagcggggcgttcatgaggatgatccgcaaatccgccggaatgccaatcacgacaaagaataagtaaatcaaataagtcccgatctcctgtgagccgcgcagccgttcaaaatagcggggaaacactaccgtcagcaaaattgtcagcgtcgtcagcagcaggaactggtcgcccagaataaaggcaagaaactgaaatccgccgtcagaagaaaaacgttccttgaaaaaagccgctgcttttacagacacagcaacgatcgcaaaggcggttccgatgtttaaagcgatgtcctgcaaggagatgtcttttctcttccaataggcttccgcctgattttcgcggccgcccgccacttcctgaacgccgaagcgtttttgaaaccatgttagcgccggtatccccattaaaatgaaaaaaagaaaagccatcataaaattatccgcaaccaccgtcgatgatacatactcaccgggagttgagaacttggcggccatcgctgcaaaattcacgcctcccccgatataagaggcgctgatcatgccgccgattttatcaaggtgcggaatctgatccttaaacagaaaaaaagcaatgacgcttccggccgcagtgcccagcgcgctgatgcaaaacatcatcaaaagtctgccgctttctttcaggatcttccgcacattgatttgaaaaagcagcaaaggaatcgcaagcggaacaacataggaccacaccgcatcatagaagggcgactcggccggaagaatccctgcattagtaaacagcatcgatccgcccagtgccaatacggcccccgatacagcggcagcccagcgaaaccgctgctctaaataaatactcacagcagcccacaccgcgataaatccccaaagcacccacacgtcatccggtgaaatcaatgaagaattcataaaaaaaccccctgtttccggttagtgttttgaattatctgataattaaatagtgtaaaacggaatgcctaattgatcaatgatcataaaaaaggtcaccatgttgacaaaattgcagaaagagggtattgtacatttgtcagcatgttgactatattcaaaggagagaacaaatggatatcaacggcttaatcaacgaattacatttgatgcagcaaagctatgcgacattgttttcggttgtcaataaggtgcaaacccgcggtgacgaatatatggaaatattaactgccaggcaacacatggcgctcatcgctatcgcgcatttgccgcctgaaactgccacgcttacgaatatctccaaaaagcttggcacaaccaaacagaccgccaacaagctgatgactggtctggtcaaaaaaggctatgtcaaatcagtgccaagccaaaaagacaaacgctccattaatattgaaatgaccgctgaaggaaagaaagcgctggtggagtgttccgaaaggtccgtctatttcctggccgacttgtttcagcaatttacatccgaagaggttgcgacattttggcggctgttgcaaaagctttaccgttttgacggtgaggaacatgacggttttgaggagaatgcaaacattcagcttggcgtggggaattcgttagatacagaaaggattctcggagaatttgagaaacgccgctatggaggagaaaacgatgaaaagtgatctttatgtaaaagcaacaacttttaaaatcaaggcaaagaagaagttctatcatgcaaaagataaattccgccagacaaaggaaaccattcgccgcggcacaaaattagacaggacaggcccctttttctcaagctgcattgctctgatcattattggatgttcctgggggacaaacgcagaatggctcgtctggttaggggccgcaagtcttttaagcaacgttttattgctgtttgcaacattttttcgccgtaatcaaaagtcaatttgacattcattgtgcgtctaatggatcgtatcgtagatcaatcaatgacttgcgacaaggatgttcagaaacttattgaattgtagaatagtgatttcaaagacaagaagccagtcttgtctttttttagttgaaacctcatatttccatatgcgtataaagaaagggaggtggaaaagtgaaacagaacaaaagagaacaacttgttaacctgtttagtgtgttaaaagaaaaaggtcagatcaacgcggcagtgctagtcgctgaagacggagacattctttatcaaggcgccttcggatatgaaaacttggcagataagcgtttattgcaggaacattccttatttgaattagcatcgctatccaagccgttcactgctttgggcatccttcaattagcccagcaaggggaattgaaaatcgaggatcccgtagaacggtggataaccgggtttccctaccagggcgtaacgattcgcgatttattgacacatacgtcgggtctgcccgattatatggagtggtttctacaacattgggatcataacaagattgctgttaatcaagatatcgttgatatgctgatgaatcatcatccgcaacgctattttgccccgggtgaaggttggctttacagcaatacgggatatgtgctgcttgcggttatcattgaaaaggcatcaggtctgagttttgcagaatatatgaaaaaaaacatctttgaaccggtgaaaatgcggaactcaagggtttataacagaaggctgcagcctgaaaccattgagaactatgcgtatggatatgtgtatgacgtgcatacagcacagtacgttctgcctgatgaccttgaagaaacaaaatatgtctgctatcttgacgggattcagggggacggaaccgtaaactcaaccattcatgacttatatttgtttgatcaagccttatatacagattgtttgatcaatcaagtctcaaaagagcttgctttttctcccgcgtctctgaaaaacggagagtctatagattacgggtgtggatgggtgcttcgggatagtcctgaaacagggagaattgtcggtcacagcggcggctggccaggctattcaaccgtaatgatccgatatatcgatcagcaaaaaaccttcatttatttgagcaatgtggaacaggatgatgaatatgaacaggccatctttgaagccgttgaaaatatcctgtttgacaaggcctacaaaatccctgatcgccctgccgataaaaagaaaaaagagatcgatccggccatttacaaaagatatgtcggaagttattcacttcaggatggcaccgccgctgatgtgacagttgataagggccggatttatatgcaaatcaccggacagatccgttttgaattatttccagcctcggaaacgcgcttttttctcaggtcattgtctgttgaagtggaatttattttggaggatggtgtcgcaacccggttgattatttatcaaaatggcgcagaggaagaagcggtgcggatagtggaagcaaacagcaaggtatgaccgttttgtttgagcgtttggcggcctgtgtctgttgtctgtcagaaggaaatttatcgtttgaaggttgactatgcaattcggggatatctgcccggctgaatttcctgatgagcatcaatcggatattcatggtaaaggtgctccatctataaggaggttaatgaggctgaacaaatttaacctgttgaaagagccctgggtgatgaatatagtggcatgatcattttgggataaagcgtttatatggaactgctaaagcaacagaaaaaaccaagcagaaaacatctgctcggtttaataactaatacttcggccagcctttagaatcccagtttaaatcattgatcagcagcttaggcgccccgttgtcaagcgcatcataaccatgtctgacgatgatgttgccgttcacgatatccgcgccgcccgggcccttccactggtcgtttccggagtcgaggattgtgcctccgccttccgtcattttcttgccgcttttgtcatagtaaggccccgtgatttttgtcgagcggccgtaagcgatcttatacgtgctgttcacaccttgacagcatttatcgaacgaaacgaataaataatagtagccgtttttatatgtgatagacggcgcttcaaccgctcctccgttgttcggccttgatgcgatggaataaaccttccctgtaggtttcatcgtttttttatcaagctttgtcagcttgatgccgctccaaaacgagccgaaggacagccacggatttccttctttatcaatcactaactcagggtcgattgcattataattgttagaggtcgtcgtccggatgacaagcccgtcgtcgcgccaatttccggatgagattcggtctgttgaagccagtccgatcgccgaagtattggagccgaacgcggataccgcataataaagccaatagcgtccattataatagctgatatcaggcgcccattggttttcttcatggttcggcacgtactttttccaccatgataatggagttgcaaatatgcttggcgctgcgctccatgtttttccgtctgtcgatttgatgacgcggattccattgccgatacccgtgccgaatgtataccacgtatttccttctttaatcatggaaggatcatgaataatgttgtctccttttgtatcccaaaaagccgctgatgttggttcagccgccgagaaaataagcagaaaaaataaaataaaaccagaaatgatagtcttagccacagttgttctcctttcaaatttcgatgtctttaacattcggccctcccttttgtgaaatatttcccaacaagacgaactttattttagcagggattggctgtctctcaatcagccaaaggacttgttttctagtcctaaaataaaacgaaaaaaccagaaaatatccatattaaaaaaacaatcacctaaaagtcatttcatcgtctgaatgtaaaagggatgatgtaattattttggcttatattggaacattttaggttaggtgaattatcaaaaactttgagatgttcgtggagaaaataaaaagcgttggaagaagaagcacggtctcccctcgaatattttcattagccccggaaggtgaatgacacttttagttgatttagtgggttgaaattgataatatgaatttgaagatagactgtcaaaataatgcatcacaaaagacgcaggcgcgtcatctacgtacggtttattaaacgttcaggtgtattttttctataagaaatgcataaaataaaaaagacccgactgcgccaacagtcgagtcgagtgtacaaagcggcccaacaagggcttggctcagtcattttaaaatagactttccctatgaactttaccagggctcaagggaagtctatttttctttcttcgacaacacggcaattaacatgccaaaagcaatcattaacgagattgtttcgaatgtcgtcataagcatcaccccctttcataggggatgagccagcttcccttgagtgagccgaaactttgtacaaagaatattttaccatacctctttcaaacactgaggctgttttttgatgttgaggcgggatagaggagaattaaataaaacgaaacacaaaaacggcaggaattccattggaaatcctgccgtttcgatttggtatgattccgactgggctcgaaccagcgacctctaccctgtcaaggtagcgctctcccagctgagctacggaatcatgatatgtaacactgggtatttgtttcgctgacaagttctattatatgcagattaggtggattcgtcaacagtttttttgattttttttgagaactgggaaagagtcttgcagtacgccgcgcgttatgaaaatattgtcttatatagaaatcaaaagggagcaggaattggatggatctgatacttaaaagtgttgatagtattttaatcgtatttttagcaatcttttttatgtggaaattcgtttatgaaattaaacatgagaagcggaaggctgttatcttgcttttgctgctcatcaatgtctattttattgtaaaagtgttcaatctcgtgttgcaattgatgtagcgaatataaaatgcagtcaaggagaccgaaatcaatgaaaacagaaaagcaaaaaatgctggacggagagctttatcatgcttctgatccggtgctgtgccatgacagactcaaggcgcgcaaaattacgaatgaattcaaccattcgaacgaaatcgacgacaataaaaggaccaagctaatcaaagagctgtttggatcaacaggggaaacgatcctcatcgaaccgtcgtttcgctgtgattacggctttaacatacatgtcggggaaaatttcttcgccaattttgactgtgttttcctcgatgtatgcgatatccggataggcgatcattgtatgctcggaccgggtgtccatatttatacggcgtcccatccgctcgatccgtccgaaaggataagcggtgcggagtacggaatacctgtcatcatcggccggaacgtttggattggcggcggcgcggtcatcaatcccggcgtcaaggtcggcgacaatgcagtgatagcttccggagccgtcgtcacaaaagatgtcccggataatgccatcgtcggcgggaatccggcgaaaatcattaaatacgttgatagcaaaaacaccaattctatgtaattggtgtttttattttgccatagacgcggtgaatgtcggggctgataaaatatccgcgggaagcagtttcctcccgcggatttaagtgctgctatcgggtgaccgtaatattgttgatgacaagctgtcccaatgaattgagatacgaaaatgtcgctttgcctgggcttacggcctttacgtatacgcggtccgaagtgattctgacggtaatggcgctgccgctgtaggagacgttcgaaatgccgacgtattgatcctcctgtccgactctcatctgcctgttgatgacgatcgcctgaggggcgatgattccttgtgcaaatgcgtgagaagagagattttcagtcttcgagagctcctgggcctgtacatgcatgggacttcccgaaacagcaaggatacccgccagtaatgatgaagcaactaaacttttacctaaccacttcataaccatcatctcttttcctatgtgatggttccaggatatgggattgttgggcggcagtcaattggctccaatgatgattcacacattggacatacgaaaaaaaacattttgtgaagcggcaggaaaaacgactcattatttcgaagatgttcttttgttcaaagcgttaataaaggttttcacatttttcttgtcctgcatgacaggtgaatatatataggaaagcgtcctgttaaaggtttgatttttcagccggataacggaaaggtttccgtgctgtacatctctttcaatgacgcttccagacaggagagacagtccgatgcccgtcatgagcgtttctttgatcccctggttgctgctgatcgtcagaaacgatttcacttttaaaccgtttgaacggatgacatggtttaagtattcgcgtgtgcctgagccgacttcgcgcgttacccacgtttgattttgcagatcggagattgtcacgtcctgtttggccgcaagcggatgatcgcttgaagcagcgatgaataattcgtcctgcataaaggcgtgtacagaaagctctttttcatttgtctgtccttcgatcaagccgatgtccactttgtacaggcggacggattgcacgatttcttccgtgtttccaatgacggccttgagctcgagttcaggatattccttttgaaggtcgaagaggagcgaaggcaaaatatattcaccgattgtgaagcttgcgccgattttcagctcgcctttgatcgagttgtggtgatcgagaatgtcctgcctcgtttgttcatagatggtgatcatttgtttggcgcggtcgtataaaatttcaccggtcggcgtgatttttaaatatttcggagagcgttcaaataatttcgtctggaattctttttcaagatttttaatgtgcatgcttacgctcggctgcgacatgagaagaagctcggccgttttcgtgaaatttttgacttctgcaagggtaacgaatgtcttcagcgcatcataatgcacacgaatctctcctttattaaaaatcttaatagctgtgataattaatatatattttactaatgttgagtattccagtaaacttttaattagaatctttttttaggaatatttggtttgaagcaggatgacgccgcgcggcaaaggggacgtgatgagtgagcgcttacaatgtttcttagcagcaaaagccgtgatcgacagatgctttgcgtcaataaaaccgatttgatttataggaatagtggatatatgatgagtattatccttttccgtttcaaaacaagtcatgatttttttattccttagtgaggtggatatcgttgcaacttcaggtaatgaacagtccttttaatcaggagcaggcagagctcctcaaccgtcttctgccaactttgacggcatcacaaaaagcctggctgagcggttatctggcagctgtgcaaaccgccgatgccgcggcggctcttgaaacattgccggcggaagctcctgctgcaagcccggctcagcctgtttccaaagaagtgaccattttattcggatcgcagacaggaaatgcacagggacttgccgaaaacgcggctaagacgcttacagaacggggatttcaagtcaccgtctcttcaatgagcgattttaagccgaaccaattgaagaaactaaaaaaccttctcatcgtcgtcagcacgcacggtgaaggggatccgccggacaacgcgctgtcattccatgagtttctccatggaagacgggctccgaagctcgatgatctccgttattctgtgctggctcttggcgacacgtcgtatgaatttttctgccagaccggaaaagagttcgaccagcggcttggtgagcttggaggcacaaggctccatccgcgcgtcgactgcgatctcgattatgatgagccggctgcagcatggcttgacggtgtcatctcaagcttaaacgaaggacaggaacagggcgcaagcgccgcacctgctcaaacggcagctccgcaagccgcgggaggagtaacagtatattcgagaaaaaatccgttcagagcggaagtgctggaaaatttgaatttaaacggccgcggatcaaataaagaaacgcgccatcttgaattatcgcttgaaggctcaggtttgacttatgaacctggcgacgcgctcggcatctttccggaaaatgaccctgaactcgtcgatatgctgctgaaagagctgaaatgggatccgaatgctgccgttgctgttgatcaaggggaaaacctttctttgaaagaagcgttgacttcttactatgaaattacggtgctgacaaagaaattcattcagcaggcggcagaaatcattgaaaatgaaaagctgcgcgagcttgccgctccggaaaatgcggatcaattaaaagcgtatatcgctggccgcgacctgattgattttgtgcgggatttcggtccgatcgcagcagctccgcaggaatttgtatcgattcttcgaaaaatcccgcctcggctttattcgatcgcatcgagcttcgctgcaaatccggatgaagtgcatttgacgatcggtgctgtccgctacaatgcgcacggcagagaccgaaaaggggtctgctcggtattatgtgccgaacgtctgcagcctggcgacaccctgcctgttttcattcagccgaataaaaactttaagctgccggagaatccggagactccgattatcatggtcggccccggcacaggcgttgcgccgtttaggtcatttatgcaggagcgcgaagaaaccggagcatcggggaaatcgtggatgttcttcggcgatcagcattttgtcactgatttcttatatcagacagaatggcaaaagtggctgagtgaaggcgtgctgacaaaaatggatgtcgcgttctcgcgggatacggaagaaaaagtatatgtacagcatcgcatgctggagcacagcaaagaattgtttgagtggcttgaagagggagcggctttctacgtttgcggcgacaagaacaacatggccaaagatgttcaaaacgcattgcttgaaattatcgaaaaagaaggcggcaaaagccgtgaggaagctgaagcctacctcgcagaaatgaaaaagcaaaaacgttatcagcgcgatgtatactgattttgattgaaaggggactttttcaacatggggaacgaaatattaaaagcgcctgaaggcccgccgagcgatgtagaacgtattaagaaagaaagcgattatttgcgcggcaccctgaaggaatcgatgctcgagccgctttcagccgggatttcagatgacgacaaccgtctgatgaagcaccacggcagctatttgcaggatgaccgcgatctccgcaatgagcggcaaaagcagaagcttgagcctgcgtatcagttcatgctgcgcgtccggatgccgggcggtgtggcgacgcctgagcagtggcttgtcatggatgagcttgcccggaaatacggaaacggaacattgaagctgacaactcgggaaacattccaaatgcacggcattttaaaatggaacatgaaaaaaacgattcagtcgatccattcagccatgctagataccattgcagcatgcggcgatgttaaccggaacgtcatgtgcacttccaatccgtatcagtcagaaatccatcgagaagtgtatgaatggtcgaaaaaactgagtgatgacctgctgccgcgcacacgtgcgtatcatgaaatctggcttgatgaggaaaaagtggccggcacgcctgatgcggatgaagtcgaaccgatgtacggaccgctgtatctgccgcggaaattcaaaatcggcatcgccgttccgccgtcaaatgatatcgatgtattttctcaggatcttggttttatcgcgattgtggaggatgacaagctcatcggcttcaacgtcgcgatcggcggcggcatgggcatgacccacggggacaaagcaacgtatccgcagcttgccaaagttattggcttctgcaagcctgaacagctatacgatgtcgctgaaaaaacgattacgatccagcgggactacggaaaccgttcggtccgcaaaaatgcccgcttcaagtatacggttgaccgcctcggcttggaaacggtcaaaaacgagctggaaaaccgtctcggctggagcctcgctgaagcaaagccttatcatttcgagcataacggcgaccgctacggctgggtaaagggcgtaaaaggaagatggcactttacaatgtttgttgagggcggccgtgtcactgattatgatgattacaagctgatgaccggcttaagggaaatcgccaaagttcataccggcgatatccgcctcacagccaaccaaaacttgatcattgccaatgtcacaagccaaaaaaagaaaaagatcagcgagctgatcgaacagtttggcttgactgacggcaagcattatacagcgctccgccgcagctcgatcgcatgcgtcgcactgccgacgtgcgggttggcgatggccgaagcggaacggtatttgccgaagctgattgacaaaattgatgaaattgttgaagaaaacggcttgaagaatgaagaaattaccatccgcatgacagggtgcccgaacggctgcgcccgccatgcgctcggcgaaatcggcttcatcggaaaagccccgggcaagtacaatatgtatctcggcgccgcttttgacggcagccgtctgagcaaaatgtaccgggaaaacatcggcgaagaagaaattttaaaagaacttcgcaatattcttccgcgctatgcgaaagaacgcaatgaaggagaacgtttcggagatttcgtcatccgcgccggaattgttaaagaaacgacggacggaacgaattttcatgactgatgagcattttaaaaaaacgcctcagcccattgattggtgctgaggcgtttttcttttttacgaaaatgcccggacagtttccgactctatgatcattttcataaactctgcagccgcaggtgttgcttcttcaaatgagggtgttatcatgccgacttcgcggataatttgaggagagatgtcttttttgatcaaccgatgggacacggaggaaagcgagaagcttgatatcaagccgattcccaaattgttatgaaccatattgaccaatgtttccgcgttttgcacagtcaggttttcttttaactcgaggcggtgtttttgaaagatttgagataccgcgatttcgtgcccgcctttacaaaaaatcaattcattttgatattttttcagatcaatgaacggtgcgtcttttaagtggtgatattgctcaggaatcacggccgtcatccggtcttgaaacaatacttggctttcgaatccgtcaaagggagaggcgacgattcctaaatcaaccatacgagtttcgacccattgcttaatttggtcggaggttccctcaagcagttcgatttgtacgagcggatactttgatctgaaggaggcgatagcctgcggcaaaatatttgctgagacggcggggaaggagccaaccttgactttccctctgagcagatgattttcttgatcggccacttggtatattttgttttcaatcacgatcatctgtctcgccagtacgacgatttcctttcccgcgtccgtaagctttatcttgttttgtttatcccgaatcaataatttgaccccgagcgacgtttccaagctttttacggctttgctcacggccggctgtgaaatatacagttcgttggctgcttctgtcatattcaaagtctctgcgactttcacaaagatgtgaagactgttcatgtttataaccaaatggttatacccccgatgataaaaatgtatttcagttatatctcaatatagcatatgctgaacatgaaacaaagaagaaaggtgacggattatgtttaaagtacttttggggatcatctctgtaacgctgatttgggggtatacctgggtgacgatgaaaatcgcaatcactgacattccccctgttttattttcggccctgcggctgttcattggagctgttcctttgtttgtgattctcttgatcaaaggaaggaaacgttcaataggaaaggagaatatcaagcattatctggtgatgagtttattgatgggtttaggttatatgggggtgttaacttacggcatgcagtttgtcgattcgggaaaaacgtctgttttggtgtacaccatgcctatttttgttactgtcatcagtcattttaaattaaacgagaaaatcaatgtgtataaaatgctcggtttattttctggtctgatcggtcttttgtttatattagggggcgggattctgcatgttgatcaaaacgtcatatttggagagctttgcgttttaatcgcagcgctcagctggggcgtcgccaatgtttacagcaaactgaaattcaaaaatacagatatgattcatatgaatgcatggcagcttctcacaggagcggtgatgttattgattttctcttttatactggaaccgtcccggccgattcactggtcaaatgaagcaatcttgtctctattgtttaacggtttattctctacggcttcgacgttcgtcatttggttttggatactgaatcaaatcgaagcgtcgaaagcatcgatggctttaatgtttgttcccgtattaggccttttgttcggctggctgcagctgcatgaaccggtcacattcagcatcctgatcggcgcattcatgatctgcatcggcatttttatgaatacttatcaatttaaaaaggtgtaaacaaaggcagaggatctatatggtaatatgaaatgggagggagatttatgaaaatcgaacacatcgccatatggacgaacaatttagaggaaatgaaagatttctatacccgtttttttcacggaaagacgaatgaaaaatatgtcaatccgaaaaagcatttcgaatcatatttcatccagtttgaatcgggaacacggcttgagctgatgagacgccccgaccttgcaaaaggagaggagaacgcttccggctatgcacatatggcgttttccttagggtcgcggcaagaggttgacgagatgacgagccgctttgaaaaggaaggataccaggttgccggaaagccgcgcgtcacgggagacgggtattatgaaagcgtcattctggatcctgacggcaacatcgttgaactgaccgtttgacggaaaaaagctaatgtccgtttttagacattagctttttcgtttagatggcagcatcgagctgattgattttccatttgttgttttctttcacaaacgtgatctttcttttcgcagtcaccgatccatccaatgccggtacggaaaattcataagtgcgggtattgtttttttgagagatcagtttgatctttgccttgtcccatcctaagaggttgtccccatcgccgacaggcacggccatttttcctttataagaaatgatgttgtatttttcaaagccttttttaatggcgtcttttgtgaaaaccggcgtcaagtagtctgttaattttgcttttgtgctgaattcactgcacatatacgtatatggaagaccgcggtattcaaatgttttggatgggcaagttgagtttttcgcttttggattgtggccgctcatcgtattccaaaagtgctcccgtgcctgcaaggttaattgcatgacttgcttatttgttaaattccctgatgtttgatttttcgctgcgagggacgctccggcaggcaagatcagtaaaacagctaataaacaaacgattaactttttcaatggtcctctctccttaaatatatctcttatattacaaatgttacaataattacagatagattacaagaggtttgcgagaaaaattttcctccgctgttttcttatatatgacgacataaaagcagccggggttatggtttgtccaggaaaatattttatgtccattgattcgtttcccggatttctctcctcataaacatagaagcctcatgttgaaaaagtattttatattgaaaaagaattctatctgggacctcgccgggagcaggaaagaggatcactgaaacatcaatgaattatattgttaaaaatcagaattttatataaaatcaaactttatcagtaaaaaaactgtaacgaaattcgcatcaatctgtcatagcggtgacattttgctgtgttacgattttccctgttagtttcaaaagggctaacaagggaggatttaacttatgaagaagacaatcatgtccttggctgcagccgcggctatgtcggcgactgcattcggagcgactgcctcagcaaaagaaatcgaagttcaaaaaggagacacgctctgggggatttctcaaaactacggaatgaacctcaaggacttaaaaaaatggaatcagctttcatcagatctgatttttccaggtcaaaagctgaacatttcttctcaagaagaaaaatctgaagaaaagcagtacaccgttcagccaggggacacgctctcaaaaatcgcaaaagagttcggtgtgactgtaagcgatcttcaaaaacggaacaacctgaagtcagacttgattattgcagggcaaacgattgcaataaacggagaagcggcagctgcagcagcgcctgtgaaacaagagtccgctccaaaacaaaatgatcagcctgtcaacgtacaaaaggaaatcacagtgaccgcaactgcgtatacggcaaatgacgggggcatttcaggcatcacaaaaacgggagtcgacctgaatgcgaaccgcaatgcgaaagtcatcgcggttgatccaagcgtgattccgctcggcacgaaagtatatgtggaaggctatggcgaagcgacggctgaagacaccggcggcgccattaaaggccataaaatagacgtatttattccagataaaaaagacgctttcaattggggcgtcaaaaccgtaaaggttaaaattttaaactgatataaaaaatgcaggaggcgttaattgcctcctgcatttttttgtcgaacgatgtttatgctgcatgctgttccgcgcgtctgctttttacaaaaaccgaaatcgcaagagcggcggctgcaaaggcgatggctacgaaataaaccatatgaacgccttctgtcatgccttgcatgtgcagctcctgacggctgcctccggaagagtgcgcgataaagcgattcgaaacggttgtcaggatcgtcgtatacaatgccggaccgattgcccctgaaacttgattaactgtattcattatcgccgaaccatgcgggtaaagcggtttgggcacctgattcaaaccgagcgtcataatcggagccattgtcaacccgacgccgagtgtaaagccggcgtagagcatcattccgaccgccatcggcgtatcgcttgaaatattcgtaaacagcgaaaggacggcaatcacaatgatcaatccggtgatcaacagcggtttaaagccaagcttatcaaacaggcgccctgcaacaagggatgtcatcgcgaggacgaggccgcccggcagcatgagaatgcctgtataaagcggtgacagctcaagcgccatttggaagtaaagcggcaaaatcagcatcatcgaaaactgcagcatcatcacgatccacatcaggataaccgagattgaaaatatctttgaacgaaacggcctcatatcaagcatcggcacttccaatctgagctggcgcatgacgaacaatattaatccgatgacaccggccgccagtccgatgatgactttcggactgctccagcccgctgcttccccggcgttgctgaagccgaaaacgatcccgccaaatccgacggtcgataaaagaattgataatatgtcaattttcggatacgtcagttcggttacatttttcaagcggaacgccgcataaaaaatcatgaagaccgatactggcagcatcatgaagaaaacaacgcgccatgaataatgttcgacaatatagcctgagatgaccggaccgatcgccggagcaaataagataacgagcgtaaggatcccggtcatcgttccgcgtttttgcggcggaatcaaagtcagtatcacattcatcacaagcggcaatatcaggcctgtacctgaaccctggatgatccgtccggcgagaacgagcgggaagaccggagcaattccggccagcaaggttcccgctgtaaaaagcgtcatcgcagacagaaacagctgccttgtcgtaaagcgctgcattaaaaacgcggtaatcggcacggcgatgccgatcatgagcatatatccggttgacagccactgggctgtgttcgctgaaatgccaaaatcgtcgatgattttcggcaaagccacattcatgaccgtctcattaatcagagcgagaaaatttccgacgattaagattgcgataatcatgaaggagccttttctagcttgttccatttgtattcccaccctttatgaacgttttagcaaaaaaggaatttgttcggcggctgcactgagaggccggccgttttttttcgtcactgagagcacatacgcaccctcaatcatcgcttgtatcgcgacgctcagcgtctcggccgtttccggcgcatagcctgactggagcagtttttcctgatagacaagctgccagtcttgataaacctgttcacacgtttggcggagcctttcactgaacgaccacgtttctgcggcgacggatacgatcggaatatcgtcgttttcttcgatgatgtattcctcgattccgtcagccatcatctggatataagattgaaacgccttgacaggatcagcttcaccgctgatcgctgacgatatatacgctttgattctttctccggttaattgaatcgcctcttgcgccagttcctctttgccgccggggaaataataataaagcgatccccgcggcgctccgctttcggctgtgatttggcttaagcctgtggcatggtagccttgtttgcggaacaatcgtgaagccgtccgcaaaattttgtcgcggctgctcattttttctgccattctatcattcccttatgattttatactgatcggtctatataattttaacgaaaaaaaagaccttttttgaaggcctgttttaaaataaggacgatttgtccatattcggttcagcgggaatccgctgaaggcttcagaaagccggcaagcagcaggcgccacagcaatcgctgccaatatcgacaaaaggctgtcagatatgaagtgaacaaaagcggaattgatggtatagagtgcgagcgccgttaaataaacggctaaaaaaacatagccgaacatttttctgcggaacggtcttttgagttgaatcaaaagaaacaatccggccattaaaatgataaacgtcacagttattctcccttcgcaggaaagtttctcaatcctcgtatgtccggtttctttctttgttgtcttcaaatgccagatgaatgacgaataaaaacagacaggcgatgatttcgacatccagcgggatggtgatgctgtccatcaattcatcagcgagatggatggcaagccaagtaaaaaaacattcgatcataaaggtcgcagctttatgcccaatcataaagctcagaattttttccgggatttcaaacagcgcgccgaggccaaaagataaaaggatataccagaagagcgaccagggcgattcgtatgtaacgccgaaaatcgcaaaaaaaccggcgacgccgaaataataagacccgaaaaagagcgtaaacacagtgaggatcaaaagaaagatcatagtcactgcgaacatggtaccgagagtttttttaatcattaatcattcattcctaatcatgcagtgtatattcatgatatcagaaaaatatccggttgtgagttataaatgagattttggggttaaagtttgtgtggatgggggagtgaagagagcgttctgaaaaattcctaaggtgtttttcgagacctaattaatcaccatatatcatatttggagcgttttcataagggctgcaatcaagaggataggatcccaaataaaaaaggctgccaaccggcaaccttactttgttaagcatatttcgtatttgcttgttcttaaaccgacgtgtttacccgaagaatcattttcgtgccttaggtgattttcgattttggttcaattgcttttttgaatctcatttgtattgtctattcattttcatcttgattagattcaaggtattgctctaaaaattccttatcatcttcatcttctggccagagtcctaaatatttgtgttcccatacaattcttctttcataatcatcagcatctgataaatcctcatagtcgtagtcgatattaaattcaccatcactgtgaatgatcatagagagactcgtccaagtctcttgatcactattcttaaattcgtaccatagcttttctaagttattgattaattgtctccaaagatttcgataggcttctttttcaatcctaaaaaattcagggatattatgacaatataccggtgaatcatttccttcaggataataataaaagaatcctttttgcacatcttcaagaatttctccataaatcaaaatctttgaccattcctctggaatagtctcaactactgtctccgcaatttcttgatatatcgtgtttaattgattttcatccattggctacttacctccaggcttattatcaaatttcacaacttcccattcccgttttccgattttatattctatctcaaagcttgccggtctttgggaattccctttgtatactggctgtattttaacctcaactgttcttcctttttcgaggtgtttggcccacatgttctcaagctttttccattctcctttatttaagttaccatccatcggcacaaggttgtcaagctttccagacccttcgaatatacttgcaatgagatgaccgccctcatcggtttttaatcgatcttcacggccggcaattctttgggcgtatttgtttctctttgctgctcccaaatttagtttgccgctgacatttgtaatacgtcctttatgatcagttttataagtatagcctacaggcgttgtatccggttttaacacctttcttcttttgactcttgtgaaatggtcaccatatttcactttatggatggtttttgagtctactttaatgtctgtttttgttttggaagaaacacccgcaatgatgctgaccattcgatttcttgcttgttttgcttgatcagaaatctttttggtttgttgaattaatttatctttcaatcgagatccatctatcgtattgaacggaactttaccagcattggctaaagctagttgaagagaagcgatttggactttcggagtgagatttttaatatctttaaaatccctgacaactttatcagctgctttcttacctgcctttttcgcactctctatgcccttgctagctgtctttttagagacatcctttatcttagatgcggcttttcccatcttgcccgccttagccaacttgctaactttgtctgcacctttcgttccgacaatggatgacgcaaccattccggtagcgtatgtaaaccatctcgccctgctttctgcatcaccattgatgacgtccctcacgaaggagtcctcgatatctttctttatgatttcaaatgtttctacagggtgggtgactgtgtaggcaatgccctctagcgtttcttttggattggttatggtatctcgtattcctgtcactgtatcgacggccacatcttctattccttcttcaatgccctgcttaatacgccccatgataccactttgttttcgttttcgatttatagtgtaaaaatagtaattttgctgcttttctgtcagattttcaattccaatctcttgtgcaatctcaacaaattcatcaggatcaatgacattttcgagcttttcctttaggtgagagattttattaacctgtttgttagcttcactaacttccttttcgagttttgatctcttatcgagcttagccaacataacgcccatcgctgtttcctggtttccactcaaggtatccattttatcctgttttaaaatagaacctttctgatagccggtgatttcaattttagggcctgtgtacattttttcaagcctagcgatgtatctttgcattgtttctaagtcgttttcagcggctttgatggtgttcgtctgctccctgtcgaatgtatgtaatttttcaattgtctgattgatttcttttaaagctttcgagtaattctcgtgaaaattactgtcatctaattccggcaaatcgactatatggctgactttagcgattgtagcattcgttttagaaaccaaacgcttcgtggtgcgatcggcatctttcactccttgttccagctcattatcgaggaaggcttgcgaaatatatccattgtgttgtggctccagggaattcaatgcacttttgattttcttcaatgctgattgatattcctcgataaaagtttcaaaaaattgaaggaatggggtgtgacactctttataaaaattccgtattgcgtcgccgccttttccttttaaggcatcgttgagcgacgtgataccttccacgctttttttaatgttgacgatttcttccgattgttgctttaattgttccaccgtttgatcaatcgctttgtgcagcgcctgaacgtccagagtcttcatggcattctcctctaatactaaagttgcaatcattttagagtttaccactttacggaagggtattggtaaatacatcctgtatacccaataaaatgaacctttcgatttaggtttatatacctactagagatttcattatcctgaaggcaacatatttacaaccgctgcgactcccggtacactacataaaaacaggacaggcaggtgcaaaaatcgaaagatgaagcgggctttaactgaccaatacggcagctttacagagatggcagaaaacgaaatagaagggaccgattattcggtggctgctcgggatgcagggagcgctctgcttgtgatggctccccacgggggcgggatcgagccgggcatcagtgaaattgtcaaggcttttgcagagggcgcttcggtttatttattggaaggattgaaaaggcgcggcaataagagccttcatgtgacaagcgctcattttgactgcccgcttgccttgcgaatggctgcaggacaccggtacatactggcttttcacgggtatgaggagcctgctcatcgacatacgctcatcggagggacagatcgaaggcgcgccttgatgtttaaggagacattggagaggcacggattttctgcggagctggcggctgaaaggggctatctttcaggtacaaaccctgcaagcatcaacaatcgctgccaaaccggtttaagcgtgcaatttgaaatcagcacagcccagcggaaggcgatgtttgagcaattcacattaaagggcaggcgaacgtctcaaaatgaggtgttttcccgctatgtcaaagctttgaaggaaggagcatgcatcgcatatgggccgagtgcagccggcagctgagccggctgtttttttattttctcagcatataagccggccggctttccgcagcgaccattttgccgaggccgtttgccgctgcgtacgggcggcgggtttcccgccggtagcgtgcaagttcgtctacttcttcaaagcgtggtgcattcgccgattcgctctcttgggaaaggcttgccatccacgcctcatgaaactggattccggcctgccgtttttcaaagagctcgatccgtttgacagcgaacgactccgtgactttaaagaggtcggcgatcattttagcggcttggcatcgcagctgaggaaaatccatttttaaaagcataaaagtagggacgcaaaaatggtacataaattgattggcctggaactcctgcagctccctgaacatctgattcatgtaaagctggtttccggcgtgctttaatacgtggcacagctcatgggcaaagtcctcccactgcttttcctttgaaaggctgctgttgagaataatgctgtacatgccgtcatgcttaatcatcatgctgttgacattttcatagtgaatccaaatattaaaatgagcggctatgcgattcatatcaatctggtgaggttcaaaaaaaccgaacttttggtacatatttttgacgtattcttctaggtgagataaataaaacttcaatacgagacaccctttcgaacgaatgttctgtttttagcgggaaagaaaagcccgtcaaaggggctgtcatgatttcatgcagatctatcatatacgatgagcagccactttagcaaatctttcccttttttattgtcttatctattaaatcggcgctcaccaggtaatgtttaataaaaattccttatttatccgttttgtttatctccgggctttcgtttcttctctttttcttttaagtattgaatgaactcgatggcctgctgtctgctttcgggggaaaattcctgcatgtcgcggtaggcaatttgcagatccggatctgcgatttcgtcttcgatgttttttttcttttccgtgcctgtcagcagatagtctatcgtcactttatagtaatcagcgagtttttttaatgtttcatagtccggctcgcttcttccgttttcataatgggagtagcgtgcccgcgatacaccgatctgctttgccacttcttcctgtgtcctttttcctctcaggctcttcagtctgccgcctaacatagaatgacctctcttcctcaattcggcatgtttatctctattatagatacaaaatgtatcgaaataaacatatgataaaaaaagtatcaaaaaagtattgatgataagaagtgtatcatatataatcaaatcatcagatacgtattgtatcaaaaacagggagtgagaacatgtgcgaaaacgattgatcgaagagcgctctaagaggggatggacccagaagcaagtgtcggaaagacttggactctccgaggtttatgttcgcaaaattgaaaggggaacacgcaatcccggcagagaaacgatgctgaaattcgaaacgctttattcagtgcctgatcgtttgctgtttcccgatctttttcaggcctttatagatacatattgtatcaaagaaaacctgcatgaaagaaggcgatgtcatgaatcttgaacatccgatggtcacacgcatccgaacacacggctatccaaaggaagccgacagagagcaaatgagaagccacggcggacttgccggatatccaaaaggaggaagcatgggtaaaattgtgatttcctacagctcagaccggtttgatcaatggcggctcggagaagccgggggattcatcgcttttacgaaagacggaaagcctgtattccaatttgatcataaaggccaatacgaacggtatctcaggctgaaccgcaaaaggcagaaggaagggggaagatgaatgtcccgcccgccggatcaaagctatcccttttcggtttactcagggcttttaacacctgttcactacgagaaaataggcaatgccatttggctttttttatggtgcatcagttcaacaacaaaggaaatcgaacgcgatggggagacatggggcatcgtgctcggcaacaagccgctgaaagcagccgaactggctcttcaattcggcgtcaacgaaaaaacgatcagaagatggctcgctcttctcgaacgaaacggctacattgcagtcacaagagcgccttacggaatgattttgtcagtcagacattcaaaaaaatttgcctacgccagccatgtccgaacagaactgcctgatcggacagaagagactggcagtgcggacaagcttgtccaatccaataaagatatcacacaaatcaacacaaaacataatatgagttccataaaaacaatagcagaacgatttgccgccctcaggtcgatgcaggaaggaaagcccgtccatccctcgtcaaaagactatcaggccatcgcccggattgtcgcccgcggagtgtctcttccgcaaacaatcaaatggcttgaacaatgttttgaggagtatgaggcgcggcgccgaagccgtcatgaaacgatcaaggtcttcagctactgtgaaaaatatatcatcggccggctggctgaagcggaagcgaaaacgaaaacaactgtcaggagggagaacaatgcccaaaagaacaatcgaagaggtcatggacgaactgagaaacaggagccgtcaatcacaggggggcaaaccggaagaatccgccgcaaaacggtatgactgtccgaagtgcaaagatgaactcggatttatcgaacggcgcggaacgatggaagtatgggtatcatgcgtctgccgcgaatggcgcaaagcgcaaaagctgttgaagacgagcgaaatcaccgaacaatttaaaaacttaaactttgctcaattcaagacggaaggaaagcatcaatctgtaaaagaggcgtatgaatgcgccgttgaatatgtacaagcttaccgggacattcaggaaagccgcagaaacagcatcgcgctcttgggacgacccggttcagggaagactcatttgctgacggctgccgccaatgagctgatgaggaagctttttgtacccgtcctgtattttccgtttgtcgaaggattcaatgatttaaaacaggacttttcgttgcttgagaataagctgaaccggatgaagcaagtcgaggtgctgtttcttgatgacctgtttaagccggtggcaggcaggccgcgggcaacggaatggcggatcgaacagacatatgccgtcgtcaattacaggtatttgaaccataagccgatcatgctgtccagcgagctaagcgttgaagaaattgtcagcatagacgaagcgctcggaacgaggctggtcgaaatgtgcggggactttctcgtcgtcctgaacgggagctctttcggcatcaatcatagactggaggggatggtttgatgtgccggctatgtaatgggagaaaatcaatccatcaggacgcaagggtcggaacgattttccgcgcttgcccgaactgctgcactgaaagcggcggtttgacggatgtgatcaaacatctggaagcgctgattgcaaaaatgaaaacaagggtgacacaaggtgcttaaaagtttaaaagctatgattctcatcatctggacagcggcaaaaagagacgcacaaattaaacgatggcacgaagaagacggaaagtgaggaaagacatacgtgaaaaacgaaagtgaggcgtacagcccatcaccatggcgcgtcgtcagaacaaataccgacgtatacatttattcagcatacagcaaagccgaaaagaaacggtttccttattccaacggaagggtgattgccaaagtcgccgactacagcgcatattccaaggaaaaaaatgcccgcttaatcgctgcagctcccgaactgttgaccgcagtgaagctcacgcttgcctatttgaagcgaaaacggcccgttcacagcgattcagttgagaatcaattgaagaatattttagaaaaagtcgtcgcaaaagcagaatttgaagaggaggaaacaagatgaaccatccggcaaagttaacagatatcaacgatacgacggttgcaagccgcatcaaaaaaggaaaggtgacggtgatcgtccttgacggaatgaacggcacggcatggcaggccgaggcgcctgagcacggcaaaaccgtcattgaaacgagaaagggagatctcgcaaggatcgaatttgaaatcggctataagctatagctctacaacttgaatatttgtccaagacggaaagcctgcggacgctgatcaggatgcacatcttaactgtgcggctgattggtgtccttttttatttcaaaaaaacggaggtacattaaaatggaagatttgcttttcgaatataaaagagcgctgaaaaacacgaaaaaattgtataagccctatcaagatgaacaagggctgacggctgaacagctgaatgataaaaaactgatcagaaacatgatgaccgatttggaatatgtgatcgactggcttgaaaacggaagagaacctggaatcagacgggcgattgacaggcgcgactcttataagcggatgctcctgaaagatccgcggatcatcgacacgttttcagaacagagtgcatttgaaccggctcaggaagtgtcagcatacgataaagcccggattgaatcagcgctgtctgcccttacggcacgcgaaaaagaaatcttcattttacataaggtcgaacagttttcctatgagcggattgccgccatgctcggcatcaaaaagtctactgttcaaaccaatgtgaaacgggcgcagctgaaaatcgcgaaacagatcgaaaagcctctcgattgtatggcataacgatatatctgtcttttgtcatacgtttgccacctataagtgaaaagagaaaaaatataacaaagcatactgttcatatggaagattcatatagcgattaaatattactgtttccgagaatgagaggcggtgaaaatgaacaatgccaaggaaaagggatccaaaaagggatgaagcttttcgtctctatcaaaaatacgggggaaacattacgaatctcgcaatcgcaagagaactcggcgtttcaaataaaaaaatcagcgtttggaaaacccgcgaccgctggcaagaggctttagccggagatgacgcgaaccgtggaaaagcagacattcacaatgaagggctgaatgaacggcagcggctgttttgcatctattatgtgaaaagcttcaatgccacccaagcggcggtaaaagcgggctattccccggccagcgcccatgtgacaggctgccggcttttgaaaaatgaaaaggtggccgatgaaatcaggcgaatcaaaaaagaaatggtaggggagatattcgtcgaggcgatggatgttctccaagtctatgtaaaaatcgcgtttgccgatatgaccgattatgtgactttcggcaaaaaagaggtacaggctgtcggaaagtccggaccgctgtttgatgaagaaaacaatccggttatgaaagaggtcagctttgtggatgtgaaacattccgacctcgtcgatggcacagtcatcacggaagcgaaactcgggaaagaagggatcgcgatcaagctggccgataaaatgaaggcgctcgataagctctcacagtattttgaccttttccctgattcatttaagcggaaaattgaaaatgagaagctgaagctcgccagacaaaaagccgacaaagatgcggaaacgggtcccgttgaagtggtcatcgcccgaaaaggtgatcaggcttgatcataaaagaagtcaatccgcattttgaagattatttgtttaactgggatcagacctttcaatttcttgtcggcggatacggttcgtcgaaaagctatcataccgctttaaaagtcgtattaaaactgcttcaggaaaagcggaccgctcttgtcgtaagggaagtgtttgaaacacacagggattcgacgttttctttattcgcatccattatcgatgagctgggtgtccaaaaggcggctcaggcggtttcttctccgatgcatatcaggtttgcaaacggcagccgaattatttttaaaggaatggacaacccggcgaaattgaaatccgtcaacaacatctcgctgatttggattgaagaatgttcagaggtgaagtatgaaggcttcaaggaactgatcggccggctgaggcatccttatcacaggctgtatatgatgttgacgacaaaccccgtcagccagtcaaactggacgtacagacactttttcaaggatgagcggaacaagcggttcattttggatgatgaggtcttgtataaaaagcgggtcgctgtcgtcggtgatacgtattaccaccattccacagctgatgacaacctgtttttgccgaaaagctacctcaaacagcttgatgatatgaaagcatatgatcccgacctgtaccggattgccagagaagggcggtttggggtaaacggcaccagggttctgccgcaatttgaagtgatggagcatgaggaggtcatgaggcagatctccgccatttccaacccgctgaagagaaccggaatggatttcggatttgaggaatcatacaatgccgtcgtccgggcggccgtcgatcccgacaaaaaatatctatatatctattgggagtactacaaaaataaaatgacagatgataagacggccgaagaacttcacgaattcgcggttgcgaaggagctgattaaagctgatcccgctgagccgaaaagcattcagtttttcaggcagaatggttttaacatgacagcagcacgcaagttccaaggctcgcgcctgcaatatacgaaaaaaatcaagcggtttaaaaaaatattctgttctgaccgatgtgccaatacgatctacgaattgcagccgctgacctatgcgacggatcaagacggcaatctgaaggaggatcagtttacaattgatccgcacacgctttccgcgctatggtacgcgcttgatgattatgaagtaaccgatttgaaggctgagccggaagtgagaaaacggccgaacaggaaaagggggagatagcgtatgtccactcagcaaacggtaagagcgaaagtcatgaaatcccgttttcacgggcctgtaacaaaacaaatatatgaagatcaattttcggagatctacggcgatgatattatcgctccgccgtacaatttgaaagaattgaaagccattgccgaatattcttcaattcttcagcaatgcattgacgcctataaaacgaatattgcggggttcgggctcgatgtagaatacgcttttgatttcaacggggcggatgtgacgcccgatcggaaaaaagctgctgagtccgattggacaaggcttgaagatttttgccgccaccttcattttgacgaatcggctgaaacaattttaagccatatgatagaggaccgcgaaaaaaccgggaacgggtttttggaggtgctcagaaacggtgcggggcagccggccggaattgaatatctcgatgtcaaaaatatgcgggtatgcggattgacagaaccgatcgaagttgaattcgcctacatggaaaacggatcgctaaaaaacatcaagagggagaaaaggttccgcaaatacgttcagatgattgacggcaggaaagtgtactttaaagagtacggcgatccgcgcgtcatggatatgaccaccggagagtttgacaggcagactccccctgaacgaagcgcgaatgaagcgatccattttaaaatcggcagcggcgtctacggcgttccgcgctggatcggaaatattgtcaacctgtacggggcgcggaaagcggaagagctgaattatatgtacttcagacaaggccggcacgtacctgccgtcattacggttgaaaacggcatgctctcagaggcttcctacagagagctgcaggaatatatgaacgacttggaaggcgttgaaaatgcccacaaatttttgctgatcgaagcggagggaatcgcacaggaaaaagacattcacggcagccaggacattacgccggtgaaggtggacatcaaatccctcgccgaaattttgcaggaagatgcgctgtttcttgaatatgacgagaaaacccggaataaaatccgctcttccttcaggctcccgccgctctacaccggtgatgcccatgaatataacagggcgacagccgataccgcccgcaaaatcaccgaagaacaggtttttgaaccggagcggaaaatattgatcggcaagctgaatacgctgtttctccgcgatttaaacattttccacgcgaggctccagctgaaaggaccggactttcgcgatccgcttgagatcgcaaaagtgctcggtccttttattcaggcaggagcagtatctgcaaatgatttgcgcgacctggccggcagagtgctcggcaagacgctagatgaatggccggaggaagaattcagcaggccgctcgtttaccaggaaagctcaaagcgtgcggaagcggaagcaggagcattgctgcctgaactgcaggaagccgtcgagacattgaaacagatcactgaaaggaggtgaacatttcgtgccgagagagcttaaaaatgccaaaatcaatttcgtcagttatgtcgacaaagcggcgaacaaaaagaaattcttcatgacgaagtcgagtgaaccgccgacatttcaaaaggaagtcaagctgattgcaaaagccgaggatgaaaagaagctcgtctacggcgttgtctacgagccggacattcaggatgcccacggcgactttatgacggctgaagaaatccaaaaagccgcccacggttttctgaaaaatgcccggaagatcgacaaggatcacaatttccagggaggcgtcggagaagtcgtggagtcctacgtagcgccggctgattttgaagtaaacggcgaaacgattgtgaaaggctcttgggtgctggtgacaaaagccggcgatgagatctgggaacagattaaaaaaggaagcatcaccggctacagcatggcgggcactgccgaaacggtcgagcacgcgccccaagccgactctgaaaccgatgagcccggcagtttctttcagctgtttaagcagttttttgccggcgacaaacaaaaaacgggagaggaagaaaaaaagatgaaacgatcagaagttcaaggaacgattgaagccgtcttggctccgcttctcaaacgtcttgacgatttggaaggggataaagcggcagatgaaaaagagcaacagacagaccaagacgcacatgtgaaggaaatcgtcgaggacatgctcgcccctcttattgcacgcattgaagcactcgaaaagatgagaggcgcctcaaagcaggcagcagccgaaaaagacggggaagaagaagttaaaaaatcgatttggagcggattgctttaatttggaggaggaagacaatgagaaatcaagagattattcgtaaagccgagatgtcgcttgcgactttgaaaagcggaggattaatgaatccggcgcaggcttctgcatttattcgcatggtgcaaaacacgccgacaattttcagcgaatcgcgcgtgattcaaatggaaaacgactcgcaaaaatttgaaaagatcggctttggccagcggattttacgagcggctgatgaaggtaaggcattggcgaaagatcaattaaccgcaccggtgaccagcacggtcgaactgaacgcgaaagaagtcattgccgaagtcaacatcacttatgacacgctcgaaaataacattgaaaaagacggccttcaacagacgctgatgcaaatgctggcggagcgggctgccgttgatattgaagaactgatcgtcaatggtgatgtcgcatcctcagatccataccttgcccagctcgacgggatccggaagcagtccgtctcccatatcgtcgatgcgggcggggagcaaatcagccggcagcttttcaaacaggggctgaaagctgttccggcaaaatatatgcgcgttcctcaggaattcagattcttcacatcgctcggccaggagattgaatggaaagaccgcgtcgcagaacgtcaaacgactctcggggatgcggcggtacagggcggactttctaccgcttttggcgtgcctgttaaaggggtctcaaatattcagccgtatgcatacggagaaggagatgcggccgccgaagcatcagacattattttgacgcacccgaaaaatatcattctcggtttctcgcgcaatatcagaattgaagtcgataaagacattcgcgcgcgcaaattcatcattgtcctgacggcaaaactggacagcaaattcgaggaagaagacgcggttgcaaaaatcatcaatgtaaaagagtaaatgctgagttcgaaccgttccaaaggaagaacagccgaccggcggaaaccgagcccggacaacagctaaaagctctggaaggatgtgatgaacatgctgatcacgcccgacgatatcatccaatattccgttattgaagccgtgaaaaaccggccgcaggaattgctgcgtcaggatatccttgaagctgaagcggaagccgagcagataacggggcaccgttttacagatgaaaaatatgatccgctgccggaaaaggcaaggctcgctttgctgcagctggcacagtactttgcattgaaaaacggtgatgaatcgcttttgaaaggctacaaatctgagaaattgggagactactcctatacgctttcaagaagcggaggcctagtgaagcccgacgtctataaactgctcgaagaatttattcttgattatgaatctgttcgattcaaggtgcgcccgctatgagctacaaaaggttattaagcgaccgctgcgatatctatcatttaaaggaagaccaggctgaggaagcaaggtacggcattcctgcgcgagacctgcagccgattcgcacatacggggaaacacctgatcttcaaaacgttccctgctattttacggaaaaaaaccagtcgatcgtccagcaagatcccgaacaggttatttatcattcatatttggcccattttccggcggaggcagatgtgcgccttcacgataaggcggtctggaacggtgtcgcctacacgctgcagcagccgcgcaacatcaaaggccatcacctcgaagtgttagcggtcagggatgaaaaactatgaaaatcaaaggattgaaacagctgtcgcagacgctggaaaaagcagggcagagcggctttcgaaatgaagctgccaagtggcttgaacaggcgggaaccgattttttggacctggtctgtgacgaaatcgtgcgcgccggatcgattgataccggcagccttttgcgctctttcaagcggggagccgaagggaacaggtgggaaatcgaaaaaggcggactcacgcttgaagtcgggacggagttagagtacgcctcatttgtaaatgacggccattggacaggcggaaaagacgaagtcaggtgggttccgggacaatggcacggcggccggtttcaatatgatcccggttcatcgtccggcatggccttaaaacggcaatgggtaaagggaacaggctattgggagcatgcgctttacatatttgagcgtttatttgaaaaacgcctgaatgaaaggctgcaaaaatggctgaattccctttaaggaggtgaagctttgaacgacgaaacgggatctgtcatgaatttcttttatcaagtctttcctgtcgtctgttatgaaaaggaaatacccgaccactttcaaataccgtcgctgtattttcctcccccttctgtttttgatgagaatgatacggtttcaacatttaaaaaagtcttcaccctgaatgtgaaactgtttcaccacgattcgcagcaggcccatgatcatgccgagcgcattgcagacgccgtaagggaagcgaggcacatcataccgctcattgaccgatcgggtaaaggcacaggggacagcttgaggatcagccggatcgagacgagaataggggattccggcaccgcgtccattattattcaatggaacagccgctactggtacaaacgggaaagcgaactttctctggaaacaattgattttacaaacggggtgaaataattggcagtcagcaaaaaaacaaacaccgaagcaaaaaaggcgcctcaagaggaacgtgaagcgctgttctacatcgaagacctgagggagcacgcgaaagagcttttcggcattaagccggaagttctcgatggtgctctttttcatgtgaaagaagagcagatttcaaaacctgaggcaagtcagcttattcaaacatttttagccaaggaggtcatgaattaatgaacggcggaacatttacaccaggcaaagaaaaagatcgtgccggcatttattttaattttaaaacgacagcagaggaacgcgtttccatcagggatcgcggtacagttgccctccctgtcgtcatgagctggggggagccgaaaacattcgtatcgatttccagcattgaagacttaaataaaaaagtagggttgaacatcgatgatccgtctcttctgcttttccgggaagcgaagaaaaacgcacagaccgttttgctgtaccgtctgaacacaggagcgccggcgaaagcccaaatcggcgaaacgctgagcgtaacggcaaaatacggaggcgagaaagggaacgacatttcgatccgcatttccgaaaatgtgctcgattctaaaaagtttgatgtcaccacctttgtcggaacagatgaagctgaccgacaaaccgtcaaaacggcagaagagcttaccgcaaatgcgtacgtcgcgtttcaaggggaaggcgcgcttgaactgacagcgggcacaaagctgtcaggcggggagaacggaacggcaagcgttgccgattacaccgcatttttagatgctgccgaaacggaatacttcaatacgatcgcactcccggtcgcagacaatgaacagctgaaagccacttttgccgctttcatcaaacgccttcgcgacaagcagggccagaaagtccaaggcgttgtcgccgattatgccggagactatgaaggcattattaatgtaacgggaggcgtcgtgctggaagacggcactgaaatcactcctgaaaaagcgacggcatgggttgccggagcgagcgcaggcgcgacttttaaccagtcgctgacatttgtcgaatacgaaggtgctgttgatgtcctgaaccgtctggatgaagaccaggtcatcgaacgtctgaaaaaaggcgagtttttatttacatttgatgcacgcgatcaatcggtcagcgttgaaaaagacatcaactctttaacgagtttcactgccgacaagaacaaaaaattctcgaaaaacaaaatcatccgcgttctcgacggagtcaacaatgacctgacccgcgagttaaaggctttaatcaaagcacgaaaagcaagcggcagcgacatccctgcatcagacgatggtttgcaatacgtcaaaacgctgatcattcagtatatgacggcgcttcaggaagccggcggcattaccggctttgattctgaaagcgatattgccattacactgaatgaagaccgcgacgggtttttaatcgatttagccgttcagccggttgatgcagcagaaaaattctactttaatgtggaggtaaaatagtatggcattaaaagcgcaaaacacgatttccggaaaagaaggccgtctttttctcgacggacaagagatggctcacatcaaaacatttgaggccaatgtcgaaaagaataaagctgaagtcaatattatgggccgccgcatgaccggccacaagacaacaggggcaaacggcacgggaacggcgacattttataaagtcacgtctcaatttgtcacgttaatgatgaactatgtgaaaaaaggcgatgatccgtatttcacgctccaggccgtccttgacgaccagtcatcaggccgcggaacggagcgggtcacgctgtatgacgtgaattttgactcggccaaaatcgccggtcttgacgtcgactcagaggcgctcgaagaagaagtgccgttcacatttgaagatttcgacgttcctgaaaaactgaaagatacgttttaaaataggagccgtatacaacgagcccgcttttcaaaaatagaccgcaacagccggtctatttcttcttttttacggaaggaaccgattcagtagtcaggaaataggaagcaaagcactctcgccaagccgagggtgctttttcattgcaaatccaaaattgaatgttaaaggagcaagcagacatgagcgaaaaacaagaagaaaaagtatatgatttatccttttttatgccgggacaaaccgttgaagccgaagaaatcaaagtgccgatctcaaagcggttcgtcgataaaaagggcaatgtcattccgtttgtgtttaagccgattacaaccgagcgcattgacgagcttgaaaaagaaaatacgacttataaaaacattaaaggcagaggccgtgtcaaggatctagacacccagcgcttttacgccagaatcgccattgaatcgacgatctaccctgacttccgttcaaaggaattaagagaagcctataaaacggccgacccggtcgaagtggccaaacgcgttctctccgtcggtggggaatatgcgaactggctcaacaaagcgattgaaatcaacggctttgaagacgatcttgaagatctggaagaagaagcaaaaaactaattaaggatgggaataaagaagcggtgtatctctatttcgcgatgcacgaacttcactattctccatcccagctccgggagctgtacgaagccccaaaaccgtttaaggcattattatacggactcatcagctacaaacttcaactcttggaaaaagaagcgcggaaaggaggtacataatccatggcaaaactgacggcacgttttgaacttgaagaccgggtgtctaagaagctgcggaggattcagaagggttttgcgattttagaaaagagagcagaacgattgaaccggcaaatcaaaattaacattaaaacggaagatcaagctttttttcggcttaaaaaactgaacaattacctgatgagaaagttcattcactccgtaaatattggagtgaatataaatgaccaggcatccgctcaactaatagaaatacaaagaagattaaaaagaattccgccagaaacaaccgttaagttaactttagcagacaatgtctcgcaaaagttaactaaaattaaaaggatgctctctaagcgtgaatatttcttatcaatctctgctgaagaccgtgtaacattaactgttaaaaaaataatcggctatcttaaaaacaatttgaaaaaaggttattcagttcagttatatgtacttgataaagtaacgaaaacagcaagcagaattgcctcgctcctaaaaaaactagagaaaacgtacattgtcacaattgatttaaacgacaaggcgaccaacaaaatcaaaaacaaaaaagtttcaggagaaacatcagaagtcaaacacgataaaaagggatctttctttgaacaaggaaaagacttgttaggcgaatggtggaaaaagtcaggatggccttggataaaggatactgggaaggaaattggcaaagcatttgtagatcgatttaaagatagactgatggaaaaattgaacaatgatatttttgacaaagtcattgataaaatcttagggcctcagtcaacaaaaggttctcagtcaaaatcaagcggaccaggccatggacaatgctgctgctgtttatatccgcagaaagatcctccgaattcagccggaaataggcaaaatgtctctgtttcaggttcaagtgaagagcataaaggctggaatctaaaaagcttatcaaggggaattcttccagccgcaaagatactcttctatttaaaaagtttaaggcccaacaaagagcccggtaaacttgcaaaattattagagcccttaaaaccaatgattgaaaaattaaagccgctaggtaaaaaactaagtccgctaggcaaacttttgccgcttacagatctaatcggcatcaacaaagataacgcaggcgaaaaaattggttctgtaggcggccgtatgttaggaacttttggtggagaagctgccggaatggcgatcggaggattggttggaggacctccgggtgcaatgattggaggagtagtgggcggctttgcaggcgggatgggcggtgaaaaggcaggcggttccctcggtaaaatgtttgacacttcccaattgaaggaagatctcatgaacacgctgtttaatggagactggtggagcgaacagtgggattcccttagtcaaaccgctacaaatacatttttaaatggagactggtggggagaaaaatggggatctcttaaagaaacagccacaaatacgtttttaaacggaaactggtgggctgaacaagccggctatctttatggtactttggaagctgcatttttagggccgttaagtaatgtttggggaaccattgcaggaacgatcagcgagacgatttttaacggagactggtggagcgaaaaatggaacaatgcagtaacatgggcgcagaatacgtgggacggagctgtctctgtttgggaatccattacaggaaccattaaagacaccgtttttaatggagactggtggagcgaaaaatggaacaatgcagtaacatgggcgcagaatacgtgggacggagccgtctctgtttgggaatccattacaggaaccattaaagacaccgtttttaatggagactggtggggtgaacaatgggacaacgcagtgacatgggcgcagaatgcgtgggacggagccgtctctgtttgggaatccattacaggaaccattaaagacactgttttcaatggagactggtggtctaaccaatggaatagcgctttggaaaggggcaagagtattttcgaaggcgcgaaaagctgggtcggagaaaaagttgaatattttcagaaaggtcgggaaagagcccataaggatcatggatttgaaggctatgccacaggcggctacatcacaaaaccgaccatctcctggatcggtgaagccggaaatgaattcgtcatccctacggaaaacaaccggggacgcgggaagatgctgcttgcccaggccgctaccaagctcggcatgcgcgttgttgacgacatgggggccgcggcgggagacgggggagcttcttctccggtttcaagcaccgcttcgtattcggcttctgtgtcgcctgctgtcggtgtcgggagtatagcagcagaggcgcaggctttcggccgggaattcaccggcggttttgacaaggggatcggctcaaacgctccttcccttgatcaatggaagcaaaaaaacatcagcaagccgtttagcagcctgccggcagaatcgtctaactacggaaaacagacggttgccgggttcgcttccggacaaaatgcttccgcgaccggaaccggcggttttcttcaagcaaaagtaaatgcgccttatcaaacaacggtgaaaacgtcctcttcctggggtgcaaatacagtcaaaaactttgcaaccgggcaaaatgcaacaccgaccgggacgtcgcagtatgttgataaaaatatcaacaagccgttccttgattcgaaacagtcggctgcaggctgggggtcaggaatggtcggacactttatcagcggcatgaatggaaaaggcagcgaagtttctcaagctgcaaaaaacttggcgaaaaaagttgaaaaagcgttccgcgaagaactagatattcattctccgtcccgggttatgatgagtctcgggcgtttcgcgtcggtcgggattgtcaaaggtttaagctctgtcgatgtcaaaagttttgcggaaaaacaagcaggctcactggcagctgcgttttccggaatcggagccgtcggcggaaatgtaaagtcgtggctgatgcaggcgatcatggctaccggttcgccggtgtcgtggcttcagccgctttctgttattgctcaaaaggaatccggcggaaatccgcgcgcctataacggctgggacattaacgccaagcggggggacccgagcagaggcttgatgcagacgatcggccaaacgtttaatgcttacaaaggaaaaggaatgaatgatattttcaatcctgttcacaacgcggtagcggccatcaactacatcaaatcgcgatacgggtcgccatttaacactccggggattaaaagcatggcaagaggcggagcttataaaggctatgccaacggcggcctgattacgagcgagcagatcgcccgcgtgggtgaaggcggcaaacgcgaatggatcattcccgaagaacgcggcatccgcggcagatatctgcttcagcgggctgcaggcgcgctcgggatggaagtgcaagaccccgctgaagggtccggttccatatcaagtgctcaggcggctgcagccaccacgggcgggacccgatcccggcagcctgctgaaaatggcgccaaagaagtcaacatctatattaccggggacaatcattaccacagtgagcgcgaccaggaaacattgattgcgaaaatcaagcgcgctcttgtcgatgagcttgaacgggatattcatattgggacgaaaggaagcgtagcttatgactaaatccgtgtacgaattttggctgacgcaaggaaaggaaaagctgcgcctccctgtgcttccagagcagcttgacgtcagcaataatcttgcgaacgaatctgtaaaggtgtcaaagttcggcgaggtgacgtttatcaatgaaccgggagcgaagacgatttcattttcgtctcattttccgaaaaagtattctccgctctcggaatacaaagggtttctttcgccggagaacgcgattcttaaaatcgagaaatggatgaaagcaaaaaaaccggttcaatttctcgtgacgggaacgaagatcaatttcacatgcagcattgaaaacttttcgcatcgcgagggtgaaaaggatatcggcgaccgggattttgatctcacattgaaagagtaccaaacagcatcaccccggaagattaaacaaaaaaagaaaacgaagaaaaaacggccgtccaaaccggctccaaaaatgtacaccgtcaaaaaaggcgatacgctctggcacatcgcaggccgtttttacggaaacagccaggaatggcggaaaatttggaatgcgaacaagcaggcgatgatcaaacgaagcaagcgaaacatcaaacagccgggacattggatttttccggggcaaaagctgaaaataccataaaacgaagcgccggatgaaccggcgtttttctggtaaatcaaaagcaggggatagcgatgatcgaattatttgtcataaaagaaagcgaatggtatgaacttgtcaccgaaagcgtcacattggaaggagaaaggtaccaggcgcctcgttcgatcgaagcgtcgattgtgatcaagcagggaagccacaaatattacagcgtgcaggaaggcgataccgttttatttaaatggaaaggaaaagaactgtttcgcggaattgtgttcagcagggtgccgaaagaatatacgcttacgtttaaagcgtacgacatgcttcagtacttggtgaaaaaccaggatgtctatgtattctcgaacaaaacggccgctgacattgtcaaacgaattgcgaacgactttcaaattcccaaaggttcgattgcaaacaccggacatacgattaaatcgctcgtctttaaagacaatacgagcctgtatgacattattttaaaagcgctgcgggagacaaaaaagcaaaccggaaaaaactatcagctgtatgccgaaaaaggaaagctgtgtttacgagcgtggcccgaaccggaggatatctgggttttggaaacgggtgtgaacattacggattacgcttacagcacgtcaatcgatgaaacggcaacccgggtgaaactgagaaagcagaaagataacaaaacctataccgcatccgcaagcgatgaagccggtatgaaaagattcggcgttctccagtacacagaaacggtttcggatgacattaacgaggcgcagctccgcgaccgggcgaagaagatacaggctgaaaagaaaggcgtcaaaaaagagctgaaaagcatacaggcaatcggcataccggaagttcaaagcggactgccggtttatatatcgattccggaagcgggcattaaagaaacctattgggttgataaggataaacacgattttacaggaacaaaacatgtgatgacgattgatgtcgtcgctaaaaacaccatacctgaaggagcgtcttcatgaaattaagcgatgcgataaaagagctggctcttggagccgtaaacgctgaatcgcctgtcgatgtcatgccggctgaagtcgtgtccgcgtctccgctcaagctgaagctccgcaatcatgataaattggtgatcccctccgacttattggtggtggccaggcatttgacagagcatacggaacagatccgaattgacggagaagacaaaacgattcgcttttacaatcaattgcatgccggcgaccacgtgatgattgcggctatgcctggagggcagtctttttttgtaatagacagagtgtaggagtaggaggtggctcggatggctctttcgccggaagtatcttttgaagatatcgaggatgacagcgatgtgattgagacttcaaaaacgtacaaaattgattttgaaacaggcaggatgacgggtgatatgatttcggggctggaagccgtggaacaaatggtttgtatggcgctgagaaccgagcgctacgcatacgccgtttacagccataatatcggaaatgaactgcaggaggttctttcagatcatgaaacgaccgacgcttataaagaaatggagataccgagattgatcgaggaagccctcatatacgatgaccgaatttcggcggtgaccgacttcgagattgagcgtcaaggcgatgccttccacgtgtccttttcggttgaaaccgatgaagggacattggaaatcgaggaggtgattggggaagatgtttgaagaccagacatttgaagagatcatggaacgcatgcttgagcgggtttcagatgagattgacaaacgtgaaaacagcgtcatttggaatgcgcttgccccggcagccgccgagctggcgctttcttatatttggcttgatcaagtgctgaatttggtttatgcggatacggctgaaggcgaatatttggacagaagggcggctgaggccggtcttgagcgctatcgggcgtcaaaagccatatggtctgcggcatttacggatggagtatcggttccccccggaacccgtttctttctggaagatttatattttaccatgctcgaagacggcaagctggaatgtgaaacagccgggacaaaaggaaacgccaatttttcggggcggcctttgcttccgctcgataccattcccgggcttgaaaaagcggttatgggaagccttgaaattcccggccgcgacgaggagacggatgaatccctgtatgaaaggtatttaatccgcgtccgtagggaagcggtcagcgcgaatcagctgcattacaaacaatgggccgaagaagtggacggcgtaggcaaagcgaaggtctttccgctgtggaatggcgagggaaccgtaaaggttgtcattacaaacgcgaaaatggagccagccacagacgcattaatcgaaagagtcaagcagtatatcgatcccgatccgggcaaaggggaaggtatggcgccgatcggagcttataccgcggttgaaagcgcggtatggaaagacgtgagcatatctgcaaaaatcatacctgaatcaggccggacgatcggtgaggccaaacaggaaattgcagaaaaaatcactgaattatttaaagaaatggcttttaaagaaagcgtcatccgtctctcgcagatcaacaacatgatctatcaatcgtcctctgtcagcgactattcggaagtcttcatcaacggggaagcgaaaaatctgcagttgacagaaacggaaattccaaagctggggcaggtgaccatcattgagcaagattgatgaaatggcttttcacctgccgccatacttgatggaaatccgggaaattcaagaaattataacggctgaagcgcctgaatttgagaggcaaaatcaagagattttcgatatgacggaccagcttttcgtcacgacggccacatgggggctggacaggtgggaaaagattttgaatgtcagacgcgaggcttcggacggcgtcgatattcgaagggcccgtctgttaaccaagatgtccaatattccgccgattacaagccgctcgatcgagcgcgcggttaatgcttttttaaaacagccgtccgcatccgtcagactgacggccggacggtatcattttttgctgagtgtaaacggagaggatctgcagtttataccttcaatcattcaaaccgtcaatcatatgaagcccgcccatttggcttatacattccggggcgggtttcattatgaatgtcggccgccgaaaagcgttcatgacaggctcgttttaagaagcaaaaacggctttttcggtacgataccggtctatttggacggacagtatctgcttgatgatgcattctacttgaacggttttcgagaaatcgacggactgccccgcaggtttaaacagcagctcacactgcgccacaagaagcggcaatacattcggtccgcctccagctttacgataaagacggccgctgaaaaccggcggaaacagcaaacaaaagctggcatgaaaaccggcattaccaatcaaaacaaaaaggtccaatccttcaaaatcagctgcaaatgcgaacatgaatttaagcaagcaggcgcgcttgaaatgagagagaagtggtggacgctaaacggcgcatttttgctcgacggtacaaagcagctggcagcagcggcgcaaaaaatcgcattgtaaaggagaaatcaaaatggcacaacaattaacagtgacaacgctttatgcgagacagcaaatggcaaaagcacgggctgagggcggcaagctcaccaaaatcacaaaaatggctttcggaaacggaggtacaaacgataaaggcgaacccgttcctctgcagggcaacgaacaggccctgaaaaacgaacttctgcaaaaggatatcgacggctttgcctttatggagccggcgaaagtccgctatacatgtacattgggagaaagcgaactcgcaggggaaacgatcaacgagctcgcccttgtcgatgaagccggaaaattcacagcggtcagaacgatgacagacaagcagaaagacggcgacatcgagttcgtctttgaaatcgacgacatttattaaaggagctgaaacaaggtggacatccaaaaaccgagacgctttgaaacaacagaccgcgcccatgccgacttgttcaacgaagcgatagatcagctgaatgtaaacgatgaacggattgcaaagcgggctgaggaagctgaagaaagggctaaaacgtatactgatgcccatgctaacgaccattcgattcacatcaccgacaaagagagggaaaaatggagcgcggggcagttatataaaataaccgaaaataacggaaaagtcttttacagaggcagttcagaaacaacagattttaacactttgacagaaaccggcatgtatctcatctataatgaaggaatcaactcgccaccttcatcaaatcggatatttttgcttgtcatgagtttcggcaataccttggttcaggcagcttatgaatcgtacaaagggacacagtcgtattttagattcagaaaatccgattcaacaacgtggacgccatggcagacccaggaaacgaccagtggagcacaggccaaggttgatgctcatgaacaaaatacgaatctccatgtgaatgaagatgaacgggaaaaatggaacaatgcacagttatataaaattactgataataatggaacgcgcacaaaactgccggatggaacggatttattaacgctgccgacaggtttttattatgctatgggccatgttgttcaaaacaaccctgtagaaaacgacagctcctggtttaattacgatgtaattgaaactggcgctggaagaaagaccatccatgcgtggcggagctatgataatactttatggcatggaacagttcacacagatggacagtttcgagaatggaaaagagtagtcacaaacgccgatttaaacgttgcttggcagactccaacgttgacaaatggatggaaacagtatgggtcgcacaaagtccggttttgtaaaaatatgcttggagaagtcgaaattattggatcaataacgggcgggacgattggctttgatattcctgcgtttacgctgcctgaggggttccgcccgattcaaatgatgcactttgtcggggtcgcatcaagtgtaggtacagggtcaacaccgcaatatcaccggacactgatcgatactgacggaagggtatgcattcaatcctgttcgaatactgtaaatccaactgagtttattacatttggttttaaatttaggactgcatagttatgcagtcctaaatagatcaaggaggcatattacagtggacattaaaaaaacaagacgctttgaaacaacagatcgcgcccatgccgacctttttaatattgttatagatcaactgaatgaaaatgatgaattgcttgttaagcgtgctgaagaggtcgatcaaaaggctaaaatatacacagatgaacatgcttcaagaaaagataaccctcatagagtgacaaaagaacaacttggtttggatcaagtagacaatattaagcaggcgtcaaaaatagaatttgattcacatctaaatgataatctgcgtcatattataagccaagaacgtgataaatggaataatgcccaactttttaaaataacatctgatacaggtatccataaatataatcttacttcgggtaccttttatgaagctttaaaagatgtgggaactggaactttttatggaacgaatgcagtggaagattcaccgtcaaatggaagtctccgcggaatgcagttggttggccaaaaagggataggtatagggtatgctattgatacactaggcaatgcatggtggttttattacaatgcagctcataccggaattaaatggtttcccattgaatctactgtcaacgcccaattgaaggcagataaaatgttaaatgatgcgaaaaactatactaaactaataatcttgagttaaagttaaccgatctaacctggctaactccaacgtttcaaaatggctggggaaattatcctgctggaagtgaggatgataaaaagaaatatgctgtccgctacgccaaagatattaccggaacagtatatgttgaaggtgcaatttccgggggaagtatcgggtttggtataccagcatttactctccctgaaggctacaggccaggaagaaattttcaatggacgggtgtggcgtcccaagtgggaatgcagggagtaccgcaatatcacaggctatttgttaacacggatggagaagtgatcattgaaaattgttcaaataaggtctatccaaacgaatatatagctttagggtttagttttaaagctaggtgattggtcacaaatggataatatcctgatatatacttattgaactggtctatagagaacggtttttatttttgcccgtgtagatgaattagggggaacatagatatgcaacaaacgtctgaattagaagtttttcaaaaggaaattacagagatgaaagctgatcaaaaatcactcgaacagcgcgtcagtacactcgaaagaacatcagaccgccacgatcagcaaatcatctcgattaacgaaaagctgaacaaaatcgaagagaatacaacctggattaagcgcagcatcacaggcgcgataattacagcggtcagcaccggcatcatcggcggcgcgatcgctgttttttataatttattgcagaaataagggaggacatcatcatgaaacatatcgacaaaggcacggtcgtcaggacggtgcttctttttattgcgctggtcaatcagacgttgatcatgtttggaaagccggttttgccggtcgctgaagatcagattcatacattggcggatgccctgtattcggccggatctgcggcttttacgatcgctgcatcgctcgttgcctggtataagaacaactatgtgacgagcaaagggaaaatgcaaaaagaagttttacagaaaaaaggtttaacgaaataaagcttcctttcagactttccagaattgaatttgaaaaggaatgatgaagtttggtcaaagtaatcaataactttgtaaaagtcaatcaatacacccgtcccgggctgaagcttgcggcagtcaaaggcatcgtcatgcattggacggcgacgcccggggcttcggctttgaatgagcgcaattatttcaatggcacctgcattgccgacaagcgttatgcgtcggctcactattttgtcgaccgccatgaggcgcagcatattattcccgatcatgaagtcgcatatcatgcgcatgatcaaaaccgctgctatgtcagctttctgaagccgaatgccaataccacggctctcggggtcgaaatgtgcgtggaaaaagacggtaccatccatgaagagacgattcgcaatgcggcagagcttgtagcggatttgtgcaagacatacggtttgtccgcagatcggattgtccgccattacgatgtcaccaacaaaagctgtccaaccccgtgggtgagagatgccggccaattgtcagctttccgtaaaagagtagacgcccttttgggaacgaaaaccgtatccgtgtcggctgcctccaccagccagacaagttcgtcatctggcatcatactcaaaaaaggaatgtcaggcgctcatgtgaaaaagctgcaaactcgcttgatcgcggccggcttttcgctgcctaagtacggggcggacggaagctatggagacgagacggtgcaggcggttgtttctttacaaaagaaagcgggaattaaagccgacggcatttacggtccgtcaactgaaaaagccctctcggccgctgaagcgtcagcagccggcaagagcaagacgtggacccttcccgacggcatttataaggtgaaaaacccgctgatgaagggaacgggtgtcacacaaatccagacagcccttgccgctctttattactaccctgataaaggggccaaaaacaacgggatcgacggattttacggaatgaagacggcaaatgcggtgaaacgttttcagctgatgtacggtttgggagcggacgggatatacggaccgaagacaaaagcgaaaatgttgtcccttttgaaataaaggaacttttaaagttcctttatattttttaaaaattttcaaaaaataactatcccacagccatacttgtatggtagtatggcggagagggggtgagagtcatgaaaatgaaacaattaaacccgcgttctgtcagagatcaaatctatcaggtgctgaaggaagaaatcatgaagtttcggcttgttccgggtgagcagatatcggaaaaagagatttcagaacggtatgaagtcagccgcactccggtcagagaggcttttttgcaactgtcgaaggaagggcttctcgaagtctatccgcagaaaggaacccgcgtgtcgctgatcgatcttgacctggtggaggaagcgaggtttatgcgggaaaaactggaaaaggctgtagctgaactggcgtgtgaggacttcccgcaggaagctatgtttaagctggagcagaatgtgaagatgcaggaattatcgatcgcacagaaaaattatgaaagtttgtttgaattagatgaagcgtttcatcagacgatttttgaaggctgcggaaaagcgaatgtctgggctgcgattcagcagatgaacgttcccttccaaagaatccgctttttaaggcttgccgccgattttaactggaacaccatccatcagcagcacgcggcattaacagaagcgattcgaacaaaacagaaggcaaaagccaaggaaatcgccgaagagcatttgcagctagtcatcgtcgataaacagatgctcattgatgagtttcccggttatttcaaaaagtaagcgctttaaaaggagtggtgatgtgaaagctgcggtgatgacgaagccttattcgattgaatttcacgacataccgcgtcccgaaccggccagcggtgaagtccttgtcaagataaaggctgccgggatttgcggaagtgatgtgcatttttacgacggctcaaatccatatgcacagtaccctcagatctttggacatgagcttgcaggcatcattgaaaaaacgggggccggcgtgagggggcgatccgcaggcgaacgggtcgtaattgaaccggcgatcccgtgcggaggctgctacccttgtcggaaagggaggacaaacgcctgtatgaacatcgatatgatcgggtcggttcgcagaggagggttcgctgattttatcattgttccagaaacgcatgtccatccgattcctgagcaaatggattttgcaaccgctgctttgtgcgagccgttttcaatcggagcgcaggcggttcggcgggcagatattcaaacaggcgaaacgattgtcatattgggaatgggtccgatcgggttaacgattttggcgcaggtaaaaaagcgcttcgacgttcgtgtgatcgctgtcgatcctgtaagggaaaggcttgagcttgccgaggcattcggggcggatgccgttattcagcctggtgaagaggatgcagagcaaatgattctgaagctgacaggcggagaaggagcggggattgtgttcgaagcggccgggattcccgcgacgattgagcaatccgttcgtttggcggccgccgccgggcgcattgtcattgtcggcttaacggggaggaatgtgacgattccgggtcttcttctcacaaagaaagatattgaaatttatggaacaaaacacagcgtcaatcaatttcccggcgtcattcaatttttgaatgaaaaccctgaaatagcccgggcttttgtcactgagatcatgccttttatggaaatagaagaggcgttgaaaaaagcgaaaaactgtccccatcaggtcacaaagatcattttatcttattgaatcggtgaggaggaagtgtgatgaaaatggttttcagatggtatggagaaggaaacgactccgtcacccttgagcagatcaggcagattcccggtgtggagggaatcgtttgggcgcttcatcatcagccgccgggtgaagagtggccattggaagaaattttagaagtgaagcggcagtgtgaacagcacggttttcacattgaagttgttgaaagcgttaacatccatgaggatataaagcttgggctgccgacgagagatctgtatattgaaaaatacaagcgaacgattgaaaatttggccaaagccggcgtaaaagtgatctgctataattttatgcctgtatttgactggctgcggaccgatttgtacaaaaaggctccagacggttccaccgctttgttctatgagcacgcaaaggtgcacacaatcgacccttttgcgcttgtcgatcaaatcgccaagcatcccgaattcacgatgcccggctgggaaccggagcggcttgagcatctgacaaggctgtttgaagcctatcaaaatgtgacggaggaggatctgtggagccatcttcactattttcttgaacgcatcattccaaccgccgcacgctgcggaatcaaaatggcgatccatcccgatgatccgccgtggccggttttcggactcccgcgcatcatgacttcaggagaaagcatcgggcggctgctacagcttgtcgatcatccggcgaatggcgtgacactgtgcagcggttcattgggcgccaaccccgaaaatgatatttccgccatgatccatgcgtatgccgaccggattccatttgcccatatccgaaacgtcaaagtctacgaaaacggcgattttatcgaaacatcgcacagaacaaaagatggcacagttgacatttgcgggattgtcaaagcctatcatgaaacaggtttttcaggctatgtgcgtccggatcacggccgccacatttgggatgaaaagtgcaggcccggctacggtctgtatgacagggcgctcggtatcatgtatttatggggcatatgggattcgctcaatagagaaaaacaggaggcttcaaaatgcttgaaatccatgaaaatttagcggggaaaactgcggtcatcacaggcggcagcggggtgctttgcggtgcgatggcgagagagctcggccggcagggtatgaatgttgccattcttaatcgaaccgttgaaaaaggggaactcgtggccgaagctgtccgaaaagccggcggcgcagcgattgcagttgagtgtgatgtcatcagccaacggagcgttgaacaggcgaaacgcgttgtggccgaccgattcggcggctgtgatctattggtgaacggagccggcggcaatcaccccaatggcacgacatcagatgaaacattcaactccgagcacatcttccaggacaacatcaagacgttacttgatctgaactgcgatgatgtcggttctgttctcaatttaaacttcctcggttctttcattccaacacagcaatttgcaaaaatgatgctgaatcaaaaaggggcgtccgtgatcaatatttcttcaatgagcgctcaaaccccgatgacgaaagtgcctgcatacagcgcggcgaaagcgggcatcgacaattttacgaaatggctggccgtctatctggccgaaacgggaatcagggtcaacgccattgccccgggatttttcctaaccaatcaaaatgaaaggcttcttcttgatcaaaacggcgaatttacagatagagcaaagaagatcatctctcacaccccgatgaggcgtttcggcaaaccggaagatttgctggggacgctgctttggctggcggatgagaagatgtccggatttgttaccggcataacagtgccggtagatggcggatttacggcttatgccggtgtctaaaaacacgataaaggggaggccggtacatgaagcagattgtgtgtgaaaagccttatcgttttaaaatgacggatgtgaaaatgccggaactaaaggatggggaagcattggtccgcatcaaacggatcggaatatgcgggacggattttcacgcttattgcggaagacagccatttttctcttatccaagagtgctcggacacgaactgtccggtgaaattgtcagcatcgataattccggcggaacgctcaagccgggcgatcaagtgtcaattattccttatttggaatgcggggcatgcatcgcctgccggaacggacgccccaactgctgcgtcaatctgaacgtcctcggtgtccatacagacgggggaatgcgggaatacataaacgtcccggcagaccacctgctaaaaacagaaggattgacgctcagcgaagctgctgttgttgaatgtttaagcatcggcgcccacgctgcagaaagggcaaatatcaaaaaaggggaaacggtgcttgttgttggagcggggcccatcgggctcagcgtgatgaaattcgcaaaattgaagggtgcaaaagtcatcgcgatggatgtcagaaaagagcgcctcacatttagccgcagatgggctgaagccgatgaagtcgtattagggggagaacatgcggctgatgagatcaaacggttgacgaacggcgactttccgacggctgtctttgatgcgacagggcaccctgcatcgatgaacagcgcttatcagtacgccgcacacgggggacggctgatctatgtcggacttgtcaacgaccatctggctatgcccgatcctgaaatccacatgcgggagctgacgattttatccagccgcaacgcattaagaagagattttgagacggtgatgaaagccatcatggatggcggagcggatgcgaaccggtttgtgaacggacagatggcgtttcacgatgttgttgacggatttcaatcagcgcttgctccggaaaccaatcctgtgaaagtgttgatccatctgtaagatcgcacgaaatgaaagcgttttctaaatttcggaaagaggggggttggccatgttttcaaacggccgcgggtttgtcatcgtgatgctttttttggcgggagtgattaattatttggatcgttcggcattgtctgtcgccgctccttttattcaggaagatttgaacatacgtccggcgcagatgggcatgctgttcagcagttttttcatcggatatgccgtctttaattttatcggcggctgggcatcagacaaatacggagcgaaacatacgctgtcggctgcaatggtcgtatggtcggttttcagcggcgctattgcactgacatataatttcgtttcactgtttatcatccgcgtcattttcggcatgggggaaggtccgctgtcagcggcaacgagcaagtcggtcaacaattggtttccgcaaaaagaaagggcaagagcgctcggcatgacaatgtgcggaacgccgctcggcggagccgtttcaggtccgatcgtcggattgatcgcgatccattgggggtggaaggcttcctttgtgttgatcatgatcatcgggcttgtttggacttgcttctggatgaaattcatgaaagataagccggctgattccggcagtttgtctcctgaaaaggaagcgcgtccgaaaaaggataccggcatcccgctgtctttttatttgaagcagccgaccgtgctgtttacggcgttcgcgttcttttcctacaactatattttgttctttttcttaacatggtttccgagctatttaacgacagcccgggggctgagcattcacgatatgagcgttgcaacgattataccgtgggttgtcggatttctcggtcttgcgcttgggggatttatttcagattatctgttcaagctgacgggcaaacagatgttttccagaaaagccgtgcttgtgtgctgccttttggctgcagcggtatgcattggatttgccgggcttgtcactaccgcgtttggagctgttgcacttgtcgcattatcggttttctttttgtatttgaccggcatcacatactgggcgattatacaggatatcgttcatccggacagggtcgggggcgtgagcggattcatgcattttcttgccaatacatccggcattatcggtccgacggttacagggtacatcgtcgagtacaccggagctttcacaagcgcctttttgcttgcgggagggctggcggtggcaggttctatttgcgtcgctttgtttgtgaaaccgatacgttctgaaaggctgcctcaatctgtaggagaaggcggacaggggcatcctttatgatgctcctgtagacatgaaaataacccccttctcagcagagaaggagggtgaaagtccaagcttcacggtttgttttttcttctgttcagcgttttaatgattttttcgcttcttcttctgagaagagaggtatagtctgacaggccgaattttgcgaaatcgacgtgtttgacttgttttttcagttttttcacagcatcacctaattcagcggtttagttgattggtttattgtatgtaagaaacgggaaaacggaataaggacgggagaatttttttcccgtcctcgttaagctttttttcttttatactcgccgatcagccgttcgttttgccggaaaatccgttcggtatgggggctgacttcgtatttcgcgatattggttttggattgccttttaaacattttaaaggcgaggcgcttttttacgctttcctggtcttgctgaaaagcaggctccatcagtcgtcaccttcctcttcgtttggtagcagaagatcatagatgcttgttaaagaagtaaacaggagataatcaaattctgtgacaaggtcttctgaggttaacttcatgacatagtcaaaatcgtggatggaaaaaggaatgaggaccatttttccgttttcttcataataaacgtctttgcggtcaagcttttcttgaacatcgaaccggttttccatatgctcaagcaaatgatccttgctttcttctgaattatattcgcaaagtgcagcggatatattcattttttcggcaaaccgtttgatgagcttttcgatgccttctgcatacgcttctatatttccataatagatgtggatcggttcgtttttcaataggtattgaaacgttttcagcctgttttgatacgtgtggaggaggtcgttgttttcttcgagaagcattcttgtatctgtcgcgagttcagagctgccgagctttttaaagtaggcatttaagaaaataaaagcgtctgtcaacgtgaaaaaaacggcaacgatcaggtaatgaagcgggtttgtgaaaattgactgcggatcgtgcgtccaatatatcacggcgccgatgacataaagaaggtaccacgtttttctgatggcgaccgttttttcggcgagctgtttttcaaaacgccacacggcagctacgtacagagccagcgccaaaacaataagccaaacaaggaattgataaaatagcagcataacttgtttccctcttcccgagaaatagtgcagttcctatttctattgttatgccggctttcttttaaacatgaaaactcccgtcctagattcggacgggagtgtgctgattaaaagaataaatcaagtatgaaataggcaaatgcaccgatggttgccgaaatgggaagggtaatgacccaagtgatcagcatccgctttgcggtgccccagtttacgcctttcacccggtgggaagcgcccacgcctaaaatggatgaagaaatgacgtgtgtcgtgctgacaggcaaatggacgatcgtcgcgccaaagatgatgagggctcccgtcaaatctgcagagacaccattgacgggacggatcttcatgatttttccgccgacggttttgatgattttccagccgccgacagatgttccgagtcccatggccatggcgcatgcaaactgcacccagaacgggatgtcggttgtactgtgcaagttacccgcgattaaagccatcgtaatgatacccatcgctttctgtgcatcgttcgtgccgtgcgtataggactgaatggcagctgtcgcgatttgaacgcgccgaaaccgcttattcgtttttgccagattgctgttcttaaaaatgactttgacgatgctgtagatcaaatatcctaaaacaaacgccaaaatgggcgataatataagtgcttcaataattttaataaatccgtggtatttaatcgcggcaaatccttccgatgcgatgacagctccggcaatcgctccgatgatcgcatgggatgagctgctgggaatcccgaaataccaggtcactaggttccatgtaatgccggcgataagagcggcaaggatcacgaccgatccgttttcaagcttgaaagggtcggcgatatcgcttgtaattgttttggctacgcctgtgaacgtcatggcgccggcgaagttcatgacagcggccataataatggcatgccttggttttaacgcttttgtcgataccgaggtggcgatcgcatttgccgtatcatgaaagccgttgataaagtcaaatgccaaagcaaagatgacaatcaatatggttaatacaaataaaagatccattataatccctcgttacgcatttttcattatgatggtttctaaattgtttgctacactttggcatgaatctgcgatttcttcaagcgtctcatagatttctctgtactggatcactttaatcggatctgtctctttaccgaaaagatttttcagcgatttgcggtgcaggttatcgcagttatgttcgtattctttaattttaatggcgtgcggctgaatttctttcaggcgattttccgccagcaattcgatcgtcaccagaatttcttttgcgcattctctgatatagccgctgaatttgtcaatatgctcatctgaagatgtgatcgagaatatttccatcatggctgaaaagtgctcgatgccgtcgagtacatcatcgaggctgtttgtaagctgaaggatgtcttcgcgttcaatcggcgtgataaatgctttgttcagctccttaatcatcgtatgtacatagttatctccttttgtctcatactcttttaaggtatccgcgaattctttaagggttgtctgattcgtcactttatagttaacaaaatactcagctgtttcatctaaattttttgcaatttccgtcaaaagcacggaaaacttgtctttttttcttttcaacatttgtaaccctccattgtttaaatgagacaatgcacacatcaaaatattatataactttttgtcgaaaaaaaacaggtgcagtcgaaaaaaacaattaattttcaaatcgtcataccttttagataggcgcaagcaccagctggcatccgggattttaagatgacaataggcgatttttcctttgatatcatcgttccaaaagaacggatctcaggatcgtttcgagaaatttgggagtttaggttcaaaaaaatagaaaattgggagtttttcttattttcagtccgctttcctgttatagtagtaataaactggaaaggaaggtgatctgatgagacggttagctttcttagttgttgcgttttgcttggcggttggttgctttttcagtccggtgtcgaaagcagaaggagtcatgagcgggggagatggtgataaagtcgccgtcgggaaagacggtatggtggctacggcccatccgcttgcatcaaaaatcggagccgaagttttgaaaaagggcgggaatgccattgatgcagctattgcgatccagtacgcactgaatgtaacagagccgatgatgtctggaatcggcggcggcggtttcatgatggtctacgacggcgagacgaaggaaacgtcgatcatcaacagcagggagcgtgctccggagggagccaagcctgacatgtttttggatggagacggaaaggtgattccgttttcagaaaggtcgagacacggaaatgcggtcggtgtgccgggaacgctgaaagggcttgaagcagcgcataagaagtggggaacaaagaaaatggaagacttgatttcgccttctataaagcttgcagaggaagggttcccaatcgactcggttttggctgacgcgataaaggatcatcaggacaagctgagcaaaacggccgcaaaggatattttccttccggacggtgaacctttgaaagaaggcgatatccttgtacaaaaggatttggccaaaacgtttaaattgatacggaaagaagggtcaaaagccttttatgatggggaaatcggccgggcgattgcagatgtcgtgcaggatttcgggggttcaatgacacctgatgacctgtcccgctacgaggtcacaacagataagcccatctggggcgagtaccacggctatgatattgcaagcatgcctcctccaagctcaggcggagtgttcatgctgcagatgctgaaattgattgatgattttcatttatcgcaatacgatccaaagtcgtttgaaaaatatcatctgctcgcggaaacgatgcatctctcctatgcggacagggctgcatatgcgggcgatccggaatttgtcgatgttccgctcagagggctgctcgatcccgattatattaaggagcggcaaaagctgatcagccttgattcgatgaaccgcgatgtgaaagagggcgatccgtggaaatatgaggaaggcgagccgaattatgagatcgtgcctcagcctgaagataaaacgatcggggagacgacgcattttaccgtcacggatcagtggggcaatgttgtctcttatacgacaacgattgaacagctttttggaacggggattttagtgcccgggtacggactgtttttgaacaatgaactgaccgattttgatgcggttccaggcggcgccaacgaagtgcagccgaataaaaggccgctttcaagcatgacgccgacgatcgtattcaaagatgaaaaaccggtgctgactgtcggttcccctggcggaacgacgatcattgcttccgttttccagacgatcttgaattattttgagtacggcatgagccttcaggatgcgattgaagagccgaggatctatacgaacagcctgacttcgtaccgctatgaatccggaatgccggaggatgtcagacggaagctcaatgacttcggccacaaattcggctcgaatccggttgatatcggcaatgtccaaagcattttcattgaccgggagaacaaaacgtttatgggggttgccgattcaagcagaaacggaacggcggttggggtcaacattaagacatcggctaaatagcggagcaaggcttggtctaaagtatttagatcaagccttcttccgtcagcggggaaaagaggatttttttcgaaagaatagaaatatattttttgaaagcgtttaccaatttataaaggaggggtaccatgattcacacgttggcaaatggattttaccgcttttgcgagtgggtgatgcggcttgcctatttgaatctgctgtggatcggctttacgctggcgggagcggtcatcttcggtttagcgccggcgaccgccgcgatgttcgctgtgactagacagtggacgctgggaaaaacggatgtcccggtgtttcagacgttttttcgggcgtttaaaaagaaatgggccaaatcaagcgttctcggtttgatattgggtctggtcggcttattgctgtttgttgattttcagattgcggccgtctattttcacgatcagccagtgtttttaagcctgttcatcagtttgtttatcatttatgccatcatcctcttatacgcttttccaattgatgtccactacgatttaaaacggattgcagtgctgaaatacagcttcatcatcggcttttcccgtccgctcacctcgtttttcatgctgatcagcgcgtttggcatgattctgctcgctttatttcatgtcacatttcttctgtttttcagcggcagcgctttaagcttcattttgacgaagctttcgtttcaggcattccgtgcaatcgacgggcgccggacagacaagcaggctgccgccccacgcttgaaatgaaggtgttcgttcggtgaaccggtatcagcatttaaaaattaaagatcaattgtttattttgatttcactgatcatggccgtttcgctcatcctgatcttgagcggcattcaatacgcgttccgggtatatgaccagcagatttacaggaagtcgtcacaggtgctgatgctatcatcaaaaagcattgaagatgaattgaaaaagattgaggatgtgtcatatcaaatcaccactgacgcagacatccaagcgaacctcctgaaagccggccgcggccagaacaaatacggacgctaccggataaaaagcaaaatttgggataagctggccgaatataccggctctaagcggtacattaaatcgattcatttgtttgatgcttccggcaccgagtactccgcaggggcgaatttaaccgaagcattgcgggagcaaaagaatgcactgatcgaaaaagcgtcgcgccaaaaaggcagcaacatgtgggagcccatgccgggtgaaaccggcgagctgttatccgtccgggaaatccgctcctatgagcgtttaaaccttgaccacctgggaacagtggtgattgtcgccgatttaaaacgggtgatcggcgatcttccgaaagactggggggaaggcgcgggcaagattgcgatgtcggacgggcgggagctgtttttttctgaaatgcctttcagccaaaccgatggcctccgattgtcttctcatgctgaaaacggatatgacattgtggaggaaaacggccagcggtttttcgtttcatatgtcaaatcagcgtataagaattggacatattggagcctgatcccctttgacgctatgttttcgaaaatttctgcaatgaagacgatcctgatttccctttttatccttttttttctgattgcggttctctttggaagaaaaatggccaggggcattacgagcccgattgagaagctggtggcggccatgaaaaatgtccaaaacggcgattttaaactggcgccgctcactcgcgctcctttagaccggcaggatgaagtcagcgtcttaaaccgcaacttctttacaatggttgaacggatcaatgaactgattgccgagaactacaagaagcagctgatgctgaaagagacggaattcaaagcgcttcaagcgcaaatcaacccccactttttatacaacacgctcgagtcgatcaactggcttgcaaaaacgaaccggcagccgcaaatttcaaagatgacggaatctctagggtttttgctcagaaatgccatcaatgtgaaaaccgacgtgctgacgatcgaggaagaagctgaaatcgtgcgccactattttacgattcagcggtttcgctttgaggagaggctcgtttttgagctcgacattgagccggctgtgaaaaaatgccgcgtacctaagcttgttctccagcctttggctgaaaacgcgattacatattgccttgagcccttcattgaaccttgccatattcaaatcaaagcatataaaaaaggagagtttgtctatttaaaggttgccgacaacggccccggcatggatgaagactttttggaaaaggcgagaaaggagcttgtccggacaagagggagaggaatcgggctgctaaatatcgacgagcgcattcagctgatgtttggcaaagggtatggcttgacgatttcaagcgaaaagaataagggaaccgagatgatgattaaaataccatttcaaagcggggtgtgatgatgtataaagtgctgttggcggacgatgaacggattattcttgacggcatctccagcatgatcgagtggaattcgttcgggacttctttgatcggggccgcacagaacgggattgatgcttaccgcctgattatggaaaagcggccggacattgtgatcagcgatattaaaatgcctgggatgggaggactcgaactgatcgaaaaagtgtcccgcgaccacccgtcaatccggtttattttgctgacgggcttcggccagtttgaatatgctaaaaaagcgatgtcatacggagtcaggcattatttgctcaaaccctgcaatgagagccatattacagattcgcttcaaagcgtgatcggcgagctgaaaaaagaggaatcggcgcaaaaagtgaaaaccgatctggagatgatgaagccgcatcttatgaagcagatgttaaaagagctgatcaccggaggcggcatcgaggatgaagcgtgcctgcgccttttttcagagcaaaaggccatcaggctgatcctgttttccgtccgggacggggaggataaagaatatgcacaaggcgttgaatccattgcggatgaggtgctgaacggtgctgtcatcgcctcggcccgggttcagcaattgcttgtctgtgcagtagacggaacattggctcctgccgtgcttgaggaaaaaatgaaaagcgtccaagagctttcacgccgcctgctccgatttgaaccagaagcatcactcagcgaaagcggcaatatcagcgaagcctccgcgatgtacgaaaaggcatatagaaagatcgtccaagatgaaggggagacatcggttttaatcggaaggatgcttgatctcatcgaaaaggaggcctcaaatccgaagctttcgctaaagtgggcagcccgcaacatgctgtatatgaatccggattatctcggcaagctgtttaaacaggaaaccggtgagaagttttcaagctatgtcgcaaaggtgcgcatcgaaaaagcgatcgcgaagatgaagaagtctaaaaacacggccatcggcacgctggcagaggaactggggtttggccacaatccaaaatacttcagccttgtctttaaaaaatacacgggactcaccccgtcagaatttcgaaaaaaagaagacaacacgttttaatgccgccgggtttatccggcggttttttgcgcattgacggaatctctgtttttttaacattcttctctgttttttgagtttctgggacagaaagctgaatttaaaatgaaatgtaagcacttacaaattggggagggggaatgttgatgagaagatttgtgtttgtctctttgtgcattttgctgacgctcggcctgttcggatgcagttcaaacactgaagaggcggccggtgcggacggcaaaaagaaggttaccttaagggtcgcatggtggggcggacagcctcggcatgattatacatcaaaaatcattgagctatatgaaaaggaacatccgcatgtcaaaatcgaagcggagtttgcgaattgggacgattattggaaaaagcttgccccgatgtccgcggcagggcagctgcccgatgtgattcaaatggatatggcgtatttatcccaatacggcaagaaaggccagcttgaagatctgactccgtatgtcaaagacggggcgatcaacaccgaatcgattgatgaaaagacgatcaaaggcggaaaaatcggtgatcagctatacggcttcccgctcggtgtgaatgtactgtcggtgattaccaatgacgacttgctaaaagaagcgggcgtcgagattgacgatggcagctggacgtggaccgattttgaaaacctggcgctagaggtcgaagagaagacgggacaatacggttcaaacggcatgcatccgcccgatgtctttttcccgtactacctcaggacaaagggcgagcgcttctataaagaggacggcacaggccttgcttattcagacgacaagctgtttgtcgattacttcaagcggcaggtgaagctcgtcgatgaaaaagcttcgccgacgcctgatgaaagcgcgcaggtgaaggggatggaagacgattttatcgtcaaaggccgaaccgctgcaacatggaattattcaaatcagtttgcggcgttcgcgcagcttaccgatgcgcccctgtcattaaagctgcctcctgaacaggcgaaggaaaaggcgctgtttttaaggccgagcatgctgttttcaattccgaaaagctccgaacagaaaaaagaagcggctgcatttatcgacttctttattaacaatgaaaaagccaatgccctgatcaaaggagaaagaggcgtaccggtctcctccaaaatagcggaaacagtgaagtcagaactgagcgaagaggagaaaaagattttcgaatatgtcgaaagggctacagcgtacgcgggagaagcggaaccgcctgagccaatcggcagcgccgaagtcatcaagctgctaaaagacacgtcagaccaaattttgtttaaaaagatcacgcctgaagaaggagccgcgaagttcagaaaagaagcggacgccatactgaaaagaaatcaacaatgataagcggggcaagtggaggaaggccgctcatcaaatccaggaggaagtgaacgtgaagcgaaaaaaaagaattgacaatttggcgggttatgcctttatttccccgtttattatcggatttttgtgctttaccgtcattccgatgggagcctcgttgtttctgtcttttacaagctacgatctgttcaccccgcccaaatgggtcggctttgacaactataaggcgatgctgaccgatgatgaaaaatactggggttcgctgaaagttacgttttattacgtgctcgccggtgtgccgctgcgcctcgcgtttgcgcttttcatcgcggtgattttgaacagagccgaaaagggtgtgggcatttaccggacgctcttttatctcccgtccatcatcggcggcagcgtggcggttgcgattatgtggcgcaatgtatttggcaatgacggtgtcatcaatgggcttttgttcttccttggttttgacaagaagattttttggtatcaggacccgacaagcgcattgtggaccttgattcttttgtctgtgtggcagttcggctcttccatgctgatctttcttgccggattgaaaaatattccgccgatgtatcaggaagcggcaagcgttgatggtgcaaacaggtttcagcggttttttctcattacgctcccgcttctcagcccgatcatcttttttaatttggtgatgcagaccatttcagccttcatgacctttacgccggcctacattatttcaaaaggggaaggcggtccgcttgacgggacgcttctgtattccctctatttgttccagcgggcgttcaactttttccaaatgggctacgcttcggctatggcatgggtgatgctgatcctgatcggccttgtcacattcatattgttcaaaacttcatccttatgggtgcattacgaatcgaaggaggggtagctggtggagccggtaaaagatatttcggggcgggccgcgcctgccccgcttcctgcgggaaatagaaagaaaagagccgggcaactcgtgtttcatatcacgacggccggtcttgcgatcatccttttgtatcccgttatctggctgatcgcaagctcgtttaaagaaagtgcgagcatattcgccacatcccactcgctcattccggaccccttgatcctgtccaattatacggagggctggaaagggatcgccggacagccgttcatcacattcattaaaaattcgcttatcattgtcggcctttcgacggccggcgcggtcttgtcctcggcgttcatcgcttacggattcgcgcggattccgtttaaagggaaggcgttttggtttagctgcatgatggtgacgatgatgctgccgcacgaggtgctgatgattccgcagtacatcatttttgcaaagctggattggctgaattcattcaagccgatcgttgttccccaatttttcgggcacgcgttttttatctttctgatgattcagttcatcaggacgatcccggtagaactcgatgaagcggcaaagattgacggctgcagccgtctcggcatctttttcagaattattttgccattgatcgcaccggcgctcgcgacgtccgccatcttctcgttttactggaagtgggaggaactgatcaatccgcttctttacttgaacaagccggagctttacccggtttctctggcattaaagctgtttttagatacggaaacggcgtctaactggggggcgatgtttgcgatgtcagtcgtctcactcgtcccggtgatcctcgtgtttttcgtttttcaaaaatcgatcgtccaaggaatcagcatgagcggattaaaataaaaaggagagaagagtgcatgacaaagcttgtttttgatgaagaaaaactcaatcaagtgatcgacagaatcgttaagcggacatttgagatggatttcgaatgggattggccgggcggcgtcgcgttttacggcgtggctgaggcgtatgaagcaaccgaaaatgaagaatacctcgagcttttgaaaaactggacggatgaaaagcttgaagacggattgcctaagctgtcgatcaacggagtatccatcggccataccctcatatcgctctaccaggcgacaggagatgaccgttatctggacgccgcccggcaaatggcggactatgtgctccacgaagcgcctcggttcgcagacggggttttgcagcacaccgtcaactcagagaaacatgtattccctgaacaggcatgggtcgatacgatgatgatggcgggcttgttccttctccgaatcggaaagcttgtcggcagcgaggaatattttgaagacgggctgcgccagtatcacggccatgaagaatttttgcaggatatggagaccaatctttattatcacgcatgggaccatgtggccaaaaacaacctgtcaggcatattttggggaaggggaaacggatgggcagctttaacgatggcaaaagcgctccctttaatcgatgttacgcatccgtcttatatgatcattgacggttcgctccgggacttgctgagcgcgcttgtcaggcttcagcatccctcaggtttatggcacaccgtactgacggacccggattcataccttgaagtgtcaggctctgccgggattgcatccggtttgctgtcaagaggctcgctataccacaaatccgttcagaaggcgctctcagccattacggatgcggtcgcgcctgacggaagggtggagcgcgtttctgcgggtacagcagtgatgcgggatgcgcagggttacaaagacgttccgtataaacggattcaaggctggggacaggggcttgccctgacctttttggcagatgtcgtccgctccaagtcgcgcgcgttccaatagaaattgaaaaaagaaacattcttttcattgcagtggggggaaaagggatgaaaaagctgcatcaaagatatgtttcacggcgtaaagggaggttttttaaaaaaagctttgtgatgatcctgctgattgcgtgtattcccggcttattgacgggtgcaggagtctatttgttttcggctgcgaaaattgaaaaagagctccaacatctgcacgagaaccaggtgaaacgccaaatcagccaaatcgatgacaagctggaagggcttgagatcatgctctcccagcttgcatatgatccgcgcctgatgaacggtctggccgatgccgatctgcaaacggattttcaaacgacgtacaagctctcaaaatcgctgtttttgcttcaggatcaaaatccgctcattcacaaggttgaactgttcattcaagggaaggagccgattctcttaaatccagaatacagcggactgaccgaccggaaaatcttgaaggcttatcattcgctgcttgaaggcggtcaaaacgtctattggaaagacatgagcggcgcttcatccggaatggcccttgtccataaaattccgggaggcatctcagaaccgttcggcgcgctgattttgacgcttgacgaaagagaattgggccggttgcttgagagcctttcgccgtattcaaagggaacagcgctcctttttcatcataatcagaagcctgtttcttggagcaatcgcggcaaaaccaactttgaaagcgccttaaaagaaaggcttgagaaacaaaaaaatccacagggctcctttgttatggattggagcggaggtgcgtattccgtttcatacggacgaatggacagattgaaccaggaatggacctatgtttcggcttcaccgatgtcggccattacggctccggtgctgtttttatcgaagctcatcgcgtcggtcagcatcgccgggatcgttcttgccttcattctggcatggtatgcgtcacacaaaatttattcacctgtcgcaaggctgatcaagctctgctccggagagggaaaggcggcctattttccggatgaatttcattggctcgagaagcgctgggaagacctatctgaggaaagcggcagactgaaaaaggaactgccccatgctgcaaacgttttttttcagcgccttctgagcggatactttgcagatgaatcagagaggaatttgagagatcgtctgaaaaggtggggctgggaagcaaaagacaatgtgtttaccatcatcgatgtccagctgacgggactctacgaaggaaacggatcttttacaaaaaaggatgaaagtctggcgggctttctgttgggaaacattacgcgcgaactggctggaaggacattcaaccatatttatatgacagatgtccgttcgctatcgcttgcggtgctgctggcgagcggccggaatacagccttcaaggaagaaatcgcccaatttgtgcgtgagctgacagatgtgatctacagcatatccaaactgcacgtcacagtgacggtatcaaaaaccgctgacaagttaaaagacattcccggcatttatgaagaggtgaaagaaggcaggcattacagacagttcgaaaacgccagccaggtgatcgatttaagccggcgggaagacatgcctcccgctgaatcatactatccgttcgctcttgaaaaagaggtagtcagggcgttgcggcttgaagaaagggatgaagtcgaaagaaggatcaggctgtttatccgggagctgtccgaaaaaggaaaaacggaaatccgcatccagccgggcatgatgcagctgttcgcaaagatccaagaagagatctttcattccggccttcacccctatgaattgttcagccgaaaaaacctgcttcaggagctttcggagctgagggagccggaaagggctgtcggctggatgatggagcgttgcataagcccttatcttaaagagatggaaggaaggaaaaacagacagcaaaaacggcttgtcgaacaggtgcttgagatgattcatcaggattatatgaacgatatctcgcttgaaagctgcgctgatcgggccgggacgaattcgtataccctgagcaaagctttcaaacaagtaaccggcatcaattttatcgactatgttacccggctcagaatcgaaaaagcgaaagagctgcttcttgagacgaataaaaaaatccatgacgtttctgaagaggtcggctacagacacagctatttcaaccggattttcaagaagcaggtcggcattccgccgagccgctacaggcagattcatcaggaatcttcgtgaaagggagagtgctatgaaacgaacagacaaaaaaccgaaagtgacagtatatttggccggggactcgaccgtcgcagactgtcccccgcatgaagcgccgatggccggctgggggcagatgcttccgctgtttttctcagatgaggctgcggtcgtgaatatggcaaaaggcggggccagttcgaacagcttcattgatgaaggccggctcgatgacattacggagcggcttgcgcctggtgattatgtgttgatccagttcggccacaacgatcaaaaaccgtacggaacagacccttatacaacctatcaggagcatcttgtccgctatgtggaagcggttcgcgaaaaacaagcgacaccggttttgatcacttccgcagagcgcagacgttttgatcaaaacggaaagcccgccgacacactcggggattttccgaaagcgatgaaggcgctcgctgacagcttcgacgttccgctgatcgatttatggtccaaaacaaaagcgctctatgaatctctcggaatcgaaggttcaaaacggctgtttgtccactttcagcctcatgagcaccctcattatccaaatggaatcgaagacaatacccatttttccgaagcaggggcccgtcaagtcgccaggctggtgacaggaggaatcagagagcttggtctgcctctatcggcttatctgctttgtgaaaggagcgatttccgtgccggagtgtaatggaagagaaggaagcctgatttatcaaaaccctttatcttctcctgaagatctccgcggctgggtgatggaagggaaaggaatcgttcgttttcagaacggccgcctgcatatggagaacgaacttgacgctgagcaatatggggacgatgctcattttgtttactggtgccctgagacattccctgatggaattgttgtgaagtgggatttctaccctgtgcgggagcctggcttatgcatgatattttttgcagccgccggcatgaatggcgaagatttatttgacgggcggctggcggagaggacggggaaatatccgcaatatcattccggggacatcaacacattgcacctgtcgtatttcagacataagcatgctgatgaaagagcattccgaacatgcaacctcaggaaaagccgcggctttcacctcgtctgtgaaggagctgatccgcttccgcccgctgcagacgctttgcctccctaccggatgaagctcataaaggacggggcatacgttcgtttttcaatcaacgagctgcccattttggaatggacggatgacggcaggcgtttcggccctgtttacggcgcaggaaagatcggcttcagacaaatggctccgctggaagcagcctacgccaactttgaagtgcgcaggctgctgcgcggctgaaaggaggagcggacatgcgggataaaggcgtaatggcgatgatgtacggcgcgtgtgaagcgatcatgaaaatcgcctggctgaacgggatctgggttttattcacgctgggaggaggcattgttttcggctgggcgccgagcacggctgcgatgttcacggtcgtgcgcaagtggctgctcggccggacggacgcaccgctgttcaaaacgttttatcaaacgtataaaaaagagtttttcaaagcaaacggacttgggctcatcctcattaccgccggaacaattttattcgtaaactatcaatttttccgcgtccgtgcggatttattttcgatcatgatcagctatgccacactggtggccgggctcatctatctcgtggttttcatttatatttttccgctttacgttcatgttcagctgccgtttgtccgctatttttcacaggctgcgctgatcggtctcgttcgccctttgacgacggccggaatggctgctgctggttgcttggtcgtgtatgtgctgttgacggttccgggtctgatcccattttatggtgtcagtttgtttgctcttgtatcgatgtttatcgcacatcgctgttttttgcgtctggaaggctagctgaactgtgcaaaaatgagaaaatcgggcaaaaaaatatcaattggaaaggctgaaccgcttaagaccggacttgaacacatcttttcccttcggcaaaaaagtgcaattgaataaaaatggaagccgtaatagaatcccttttgagtaagcgcttacaaaaatggtgaagggagaagatgatgaaaaaaggaaagaaaaggtggaagaacctgttggccgcgtcatctcttttattaatcacgctagtgaccggcttctcggagcaagctgatcagacgggcggacggctgcgcaggcaaggcaaatggaatcgcttaacagggggcttgtcgctgttaaaacggggaacggtgtctttgtcagctggcggcttctgggaaccgagccgtcttctgtttcatttaatgtgtatcgaaacggaaagaagctgaacggttctccgattacatcgagcacaaactatcaggatgcaggcggggatttgaacgccgtttaccaggtgcgcgccgttttgaacggcagggagcaggctccttctgaatccgtcggcgtattgaataaacaatataaatctgttccgctgcaaaaaccggccggaggaaaaacgcctgatggggtgtcatacacatacagcgccaatgatgcgagcgtaggcgaccttgatggagacggccaatatgaaatcattctcaagtgggatccttccaattcaaaggataattcacaggacggatacacgggagatgtgctgattgacgcatacaagcttgacggcaccatgatgtggagaatcaaccttggcaaaaatattcgcgccggcgcccattatacgcagtttctcgtctatgactttgacggcgatggaaaagcggaaatcgccatgaagacggcagacgggacgaaggacggcaaagggaaggtgatcggcaatgcaaacgccgattaccgcaatgcccaaggccgaattttgtcagggcctgagtatttgacggtttttaaaggcgatacaggcgctgagcttacaacggtcaactacgaacctgcccggggaaatgtagccgattggggagacagctacggcaacagggttgaccgctttctggccggtgtcgcataccttgacggggagcggccgagttttgtcatggcacgcggttattacacgagaacagtgctagtcgcttacaacttcagaggcggaaagctgaccaagctgtggacgttcgattcggatgctcccggaaatggcgcctatgccggtcaaggcaaccacagtttgagcgtcgccgacgttgacggagatggaaaggacgagatcatatacggagcgatggctgtcgatcatgacggaaaaggcctctactcaaccggctggggacatggggatgccatgcatacagggaacctggacccgtcaaggcctggactggaagtcttccaagtccatgaaaacagcaattctccttatggcttgtccttccgcgatgcgaaaacaggaaagatcatctggggagttcacgcaggtaaagatgtcggacgcggaatggccgctgatatcgatccgcgctacgaaggagcggaagtatgggcgaacggcagtctttatacggcaaaaggcgtaaaaatcggaaacacattgccttcatcaacgaacttcggcatctggtgggacggcgatctccaaagagagcttctggacagcaacagaattgataaatgggattatcaaaattcgcgaaccgtcaacttgctgacagcgtccggagcttcggcaaataacggaacaaaagcgacgccgtccctgcaggcggacattctcggagactggcgcgaagaagtggtctggcgagcggaggacagcagcgaactgcgcatctacacgacgacagacgtgacggagcaccgcatgtatacgctgatgcatgatgcagtctatcgcctcggtatcgcctggcagaatgtcggctacaaccagcctccgcacaccggcttttatttaggcgaaggcatgcagacaccggagaagccgaacatttatacacgctgatgataaaggggagctgcataatgaagcgatatgttcgctgcttatgggtcatccccctccttttctttttcatcatgggaatgggggacctgcgcagccgaaagccgctgccgcgcatcacagtcaggatctttttctgttcgattttggaaaaggtcccgctgagaaggattatgtgaaagtgaacgagtcctccgtgtatcaaaatggtgctggctacggattttctcaggcaggaagcgctgtgtgcaaaaagacgcaaaaaaaagaagcgctcaaaaaagactattgtatcgtgaaccggacggcttttctggcagatctctcccccggcaaataccgcgtgaccgtttttgcatcatccagcggtgaattgaagctttatgccgaaggagaaaaaatggggacgatcccggccggagcaaagggaagctcagccgaaaaagcgttcaccgtttcggtggaagacgggcgcctcgatctggagtgaaggggcctcagccaaaggtgtatgccatcgaaatttcgaggtgtatcagttcgatttcggtgacgggcctcttgcttcgggttttattccggtaggcgctgcttcggcctatacccctctaaaaggctacggatttgacgacgcggcaaaggtgtcctgcacggaccgaggtacggccgacccgcttcgttcagacttctgcattccggatgggacggcgtttactgtcgatttgcctgacggtcaatatcaagtccaaatcataaccggagatgcgcgggcaaagacgaacatggacgtacgggcaaacggcatgctccagctgtattcgtttggagcggaagcgggcggatacaacgaaaaaacgtttccgattcatatttccggcggccgtctttcgatccaagccttaacggcgagaacaatgccgcgccttaatgcgttggtcattacgaagacggcttatcatgtgacggatgacaacacgacggtctttctggcgggcgattccacggtctccgattatgagcccggctatgcgccgatggcaggctgggggcaatttttaggcggctatttctcggatgaaatcgtcatcgacaaccaggcgaaacgcgcgagaagcgcgaaaagttttgtggatgaacggtcgctggctacgattttgaaccggatgaaacggggcgactatttgttgattcagttcggcattaatgacgcagggcaagatcctgcccgccatacagatccgtatacgacatttcaggaatacttgagaacatatattaacaaagcccgcgaaaaaggaggacgtcatgtgctcgtcacttctcaaagcaaacgtacctatgatgaaaagggcgttttctacaacagcatcggagaatatccgaacgcaatgagacagctgggacgggaaatgaacgttccggtgatcgatttaaacaaaaaaagcattgaatattacaacgagatcggcgttgaagcgactaaaaacgtatttatgtttctggaaccgggagaaagcccgaattatccggaaggcatccaggacagggtgcattttcacgagttcggcgccaaccaattggcaaggctcgtcacaggagaaatctccgatttgaatatatatccgctgaaacactcgctcaagaaataaggtgtcgggagatccggtctccggctctcccgttcgccattccaaaccgcaaagggggagagaggactatgggagaaaaggacagacatgcagcagctgatcgcgttcgtccggtgaaaacggcggcaaaaccgaagcaaatggaacacttaaaccgcggccttgtggcggtaaaaacaaaaaagggggtttttctcagctggcggctcttaggaaccgatccggaagaaaccgcttttaatctataccgcaacggacaaagaatcaattcaacacccatttcatcatcgaccaactttcttgataaacacggaaatggaaaatcgctttattatgtgtccaaggttctcggagataaggaagtcgagacgtcgcccaaaacagctgtctggcagaagccttacttggaagttccgttaaacaagcctgacggcgggacaactcctgacggcgcaccgtatacgtacagtgcaaatgacgcgagcatcggagatctcgacggcgatggagaatacgaaattgtgctcaaatgggacccgtcaaattcgaaagataacgcgcacaacggctataccggagaagtcatcatcgatgcctataagcttgacgggacattcatgtggagggttcatctcgggaagaacatccgcgcgggcgcccattatacccaattgatggtctatgatcttgacggcgacgggaaagcggaaattgctatgaagacggctgacggaacagttgacggaaccggccgggtgatcggcgatcaggctgccgattacagaaatgaaggtgggcgaattctggccggccctgaatatttgtcgatttttcacggggaaacgggaagggaattggcaaccgtggattacgatccgccgcgcggaaggcttgaggactggggagatggatacggcaaccgcatggatcggtttttggcaggcatcgcctatttggacggcgaaaggccgagccttgtcatggcccgcggctattacacaagaacggtgctagtcgcttacaacttccgagacggcaagctgaccaagctgtggacgtttgacagcgacaagcccggaaatgaaggctatgccgggcagggaaaccatagtctgagcgtcgctgatgtcgacggtgacgggaaagatgagatcatctacggcgcgatggccgttgatcatgacggaacagggctttatacgacagggcttggacacggtgatgccatgcacgtgagcgatcttgacccggaccggccggggctggaagtctttcaggtgcatgaagatccgcgccttccgtacggcctctcatttcgcgatgcgggtacaggggaaattctctggggagtgccggccgatacagatgttgggcggggaatagccgcgcatatcgatccccgctgctataaaggagcgcttgtctgggcgatcgatccaccgggcaatgaaggaaaatcgtacggcctctatacgagtaagggagaaaagctcagcgatgccgctccggcttcggccaattttgcgatttggtgggacggcgatcttctccgcgagctgcttgaccacgattggaaagaacccgcaggcatccccaaaattgataaatgggactatcacagcggcaggctggtcaatctgctcaccgctgacggaacgctgtctaacaattggacgaaagggacgccagtgcttcaggccaatttgttcggcgattggcgcgaagatgtcgtgttccgcacagtccgaagcgatgctctgcgaatttacacaacgaccgagccgactgaacaccgtttctatacgttcatgcacgatcccgtctaccgcctgggggtagcctggcaaaatgtcgcttacaatcagccgcctcatcccgggttttatgtgggaaccggaatggacaagccgccccggccgaatatttataccgttccttgtaagagaaatgaagaatgaaagagaacggcggttcagcatgcgctgggcccggggcaccggcagaaatattcaacttacaaaaaagtatgattgtaatcttacagcctgttccataaaatgattggtaagcattttcattacaaaatgaaaagggggatccatatggggtatcaggcgagtgatgtacgctatgaaaatatgaaatacaacctctgcgggcattcaggattaaaactgcctgctttgtctttagggctttggcacaatttcggagaagcggcttccttgcaaaatgccaaagcgctgttaagaaaagcatttgacctgggtatcacccactttgacttggcgaataattacggtccgccgcccggttctgccgaagaaacattcggaaaagcgctgaaaaccgattttgccggctaccgcgatgaaatggtcatcagcacgaaagccggctatacgatgtggcccggaccatacggcgattggggatcaaaaaagtatctcgtggcgagccttgatcaaagtttaaaacgaatgggcatcgattatgtcgatatattttattcacaccgccctgacccccatacaccgctggaagagacgatgggagcgctcgcccacatcgtcaggcaaggaaaagctttatatgtcggtttgtcgaactacagtgctgaacagaccgaaaaggcggctgatattttgcaagaatacgggattccgctcctcatccatcagcccaaatattcaatgttccacagagaaccggaaaaaggcctgctgcaagtgctgcagaaaaaaggagccggggcgatcgcgtttacacctcttgcccaagggcttttaacaacgaaatatttgacagggattcccgccgggtcaagagccgctgatgcgaacagtccgtttttgcaggccgagggcatcacagaagacgtgctcggcaaggtccgcaagttgaatcaagtggctgccgaacgcggccagtctcttccgcaaatggcgatagcctggctattaaaagacccgcgcgtcacctcggtgctgatcggcgcgagcaaaaccgaacagatcgaagaaaatgccgcggcgcttaagtccgctcgattctcagctgaagaactcgacacaattgataaaattctttcataaataaggagtggtcgtgatgacaatcagcatctatttggccggcgattcgaccgtgcagcattataaggctgattcgcctcagggaggctggggcgaatttctccagtcttatttatccggaaatgtacaggtgatcaaccgggcaatcgggggccggagttcaaaaacgttcgttgaagaaggaagacttgcatctattttggatgtgatcaaacaggatgattggctgttcgttcagatggggcacaatgatgcgtcgaaagacaaaccagaacgctatacagagccgtatacgacgtataaacaatacttgaaaatgtacgttgacggcgcgcgtcaaaaaggggcatcgccgcttctcatcacacctgtcgcaaggctccattacaaagacggcgtctttttaaacgatttcccggactactgcattgcgatgaagcaggtcgcaagcgaagaaaacgtccgcttgatcgatttaatggacaaaagccttcagcattttgcggaaaaaggatacaacgaagtatttaaatattttatgatctcggaaaatgtcaacgactatacacattttacgaaaaaaggggcccgggaaatggcgaagctcgtctcggagggcattcgagagcttgggctgccgtttgtcaaagagacggtatgaagatgaacggaaagctgtaccatggcgcttgcttttatcccgaattgtgggatgaggatgtgctggatgaagatatcaggatgatggagcgaatcgggatcaatgttgtcagaatcggggagtttgcctggtcaaggatggagcctgaaaaaggaaggatcgatgtcggattttttgcagacgtcatccgaaagctccgcgacaacaaaattgaaacggtcatgtgcacgccgactgcgacgccgccgatctggctgacccacgggcacccggaaagaatgcatgtgaatgaaaaaggggagacgatgggacacggttcgaggcagcatgcctgcacaaaccatccctatttcagagagcgggcccggctgatcatcaaacatatcgccaaagagatcggagaactgccgggattgatcggatggcagcttgacaatgaattcaaatgccatgtcgcagaatgcatatgtgaaacgtgccgcacattatggcacaaatggctggaagaccgctatcagacgattgaccgtctgaatgaggcatggggtacgggcgtatggagcgaaacgtatcagtgcttcgagcaagtcccgcagcccggaccgaccccgtttttgcataattcttctttaaggacaatgtatcagctgttttcgatggacaagatttctgaatttgcgcgtgaacaggctgaggtgatcagagcatactccgatgccccgatcacccataatagcagcgtcatgttcggcgttgatcatgaagaccttttcaagagccttgattttgcctcgtttgatacgtacgccagccaggaaaacagtcaagcctttttgtttaattgtgatttatggagaaacatcaaaaaaggacggccgttttggattatggagacgagcccttcctacagcgcttcgcttgaaagctatgcggtgcctcatcaaaacggctatttgaaagctgaagcggtttcttcttatgctcttggcggagccgcgttctgctattggctgtggcgccagcagagagccgggtctgaacagccgcacggatcagtgctcagcgcatggggggagcctgatgtgggatatgaaaatgtgctcgaagccgagcgggcaagacgagaggttgaacacatcatgctggctacggctcctttgcaggctgaaacagctgtcgtctattcggaccgtgcgaaggtgtttttgaaaacggagcctcatcggggtcttcattacagaacgctgatcaccgagttttatgaccgattattaaagatgggcattcacagggatgtcattcttgaagggagcccgctggacggctacaaactgctgtttacgccgtttattcattatcttccccctgcttttatcaaaaaagccgaagcatttgcacaaagcggcggcatttggattgcgggtccgctgacgggcggaagaacagagcaccatacgattcacactgattgcggattggggcctttagaaaaatgttctggtgttaaaacgctgtttacattcccgatggatgagcggaactcaagcggaacggcgtttggcgtaaaggcgccgctgagcttgtggagcgctgtttttgaagccggcggcaccaaggctgtcgggatgattgagaaaggcccggcgtcaggcaaagcgttcatcacggaacacaaatgcggaaaaggcaaaatcgtcatgctcgggtcgatgccggcaggcgaagcgggggacatcatgatgaaaaagctgatcagccattatgccgaagaagcgggcgttgagcagaaaaccgatgtcactcccggaacagtcgtcgcgccccggaaaggagcagacggtcttgtctgggtcgtgatcaatatggacggcaaaggaggcgcagtgacacttgacggcaacggaaccgatcttttatccggcaggcccgtaaccggacgcgtaacactcggcccgcacgactaccgcgtgattttgttatcagagaataaatgaatcgccgcaggctcttgcccgcggcttttttggtttgttttgcaaaaaacgatgattcctgcaaaaaaggagttggcatcccgctatcataagcaaaaaaggaatattgacggtcaataggctaaacaggaaaatattcactgaccaatcggttgaacagaaaggaggaacgcttgtgaaagcacaggctgaactaaaatggctgaatagagcgcctgcttcgttcggcggggtgacttggggagtgccttgggcaaaaggagtgctgcaaaaaggggagacggccgtcatcgcttcggaaaacgccccgtatttgcaaacatggccgcttgcatattggcctgacggctcgattaaatggacgggccatgccgcagtattcccagaagaaagcggacgccgatttacattgcaaaaaggaaagcccggcgcgccgaaaaccgtcgtccgtgtcagcgagcagaaagacgaaatcacggtgaatacgggcgcgatagtctgcaagctcggaaagtcggggccggcactgatccgttcgatttccatttccggggaaatgatggcgaaagaaggacggctcatcgctttaaaagaaaaaagaagcggttcagatacacaaagcatgtattatattgaacggtttgagagcttggtcaaacgtgcggcaatcgaacaaaacggtccggtcaagacagtcatcaagattgaaggcgtccaccgcggcggaggcatcgatgtttggctcccttttaccgtcaggctttctttctatgccggtgtcccgtccatccggatcgtgcacacgatcttcatcgactgtaacgcagaaacggaatggatcaaaggactcggtttagagatgagcgcggttttgagcggagcgccaagaaacaggcatattcgctatgcagccgacggaggaatttacggagaggcttctcagctgcttgtgacgagaagatttaatgaaacaaacgggttctatgaacgacagatagccggacagcctgtcccggaagagtcggaagtcgtgcgtgatgcagagaaaaacgccgtctggaacgatttcaagctcattcaggattcccctgttcactggcgcttaaaaaagcgaaccggcaaagactgcgcctgggtggacgcgattcatggggggagagcgaaagggctgatgtatgcaggcggggaaaatggcggcatcgcgctcggcctcagaaacttctttgaaaaatatccatcatcgcttgaagcgcaaggtcttgccggcggcgaaacaaaattgacggcatggttctggccccctgaagctgaagcgatggacttccgccattattcaaaaggcactcacgttgaaagcgcatatgaagggtttgccgaaatgaggtcgacggctgtcggcattgccaatacgagcgaagtcaacctcgcctgtttttcaaatccgccgagtaatgaagagctgaacagagcggcggacgaatggcaaaatcccccattgcttatttgtgagcctgactattattatgacacccgcgctttgggtgtttggagcctgaaagataaacggcgcccgctctcagctgcgcttgaagatcagctggacgaggctctcaagttttacatgaacgaagtcgaacagcggggctggtacggctattggcattacggtgatgtgatgcatacgtacgatgccgtccggcatgtatggcggtatgacctgggcggctatgcatggcaaaacacggaactcgtaccgaacctctggctttggcagtctttttttagatccgggagggaagacatcttcagaatggcagaagcgatgactcgtcacactagcgaaatcgactgctaccatttcggggattataaaggcctcggttcaaggcacaatgtcctccattggggctgcggctgcaaggaagcgagaatcagcatggccggcctccacaagccttattattttttgacggcggatgagagaacgggggaagtgttaaccgaggtgaaagatgccgatcgagcgcttgagatgcttgatccgatgagagcctattatccggaaaaagagttccctgcccacgcgagagttggccccgactgggcggcgttctgttccaattggctgacggaatgggagcggaccggtgatgaagcgtaccttgataaaatcaaccggggaatcggccggctcaaagcgctgcctcttcgtctgctgtccgggccgactttcggatacgatcctaaagcttcagatctgcttcatatgggtgacgggaatcatggcggctatcatatggtcatcgcctttggcgccccgcaaacatggatggagcttgcagaactgctggaggataacgaatggaaggagatgctcggcgaattcggcgaattttatttgctggctgatgaagaaaagcgcaagaggagcggcgggaagcttcacgatgatttatttcactggccgatgttctccgctgccatggccgcttatgctgcgaggcttcaccaagaccggaagcttgccgaaaaagcatggcggctgttgctggacgaaaaacaaagccatacaccgctgccgatcgctccaaaacaagtccatgcgtggaacacgatcacggaaatcccttgggtcacgacaaactgcgtctcacaatggtgcctcaacacaatagccgtgctggagctgctcaaggatatgccgcctgatcaggacatgcaagaaaagatcatcaaagcaatgaaagatcatcccgctcgcgtgtgagggcaaaaaatgaaggttgccggaaaaatgtaagcgttttaaattcgagtggaacaatgaaacgatcaaaagggggaattgtaaaatggcaagactgaagctgaagggaaacaagtggctcgctgcacccgctgtctttttgctccttatcgggtgcagtgcaaatgagacgtcgaatcaagacgggaaaggaaaagagaaggatgccattcatattatggctccgctcctctcgccggaaagtccgggagaaaacagtccgtctttaaaagcgctcgaaaaatacacgaaaaaacaaattaaagtgacatgggttccgaactcttcctataatgataaattcaacatcgtcatggcctcgggggatttgccgcaagccattgtcgtcacggacaagtcgccgggttttatcaagtctgtcaaatcaggcgcgttctgggagctttcaccttatttaaaagactacccgaaccttggaaaggccgatgagaaagtgatgaagaacagttccattaacggcgagatttacggcatttacagggcgagggacctcatccgcgcttcgattatcatcagaacggactggctcgaaaatgtcggcctggagatgccgaaaacaatcgacgaattttacgacgtactgaaagcgtttaaagaaaaagaccccgacggaaacggaaaggacgatacgtacggcatggtagtcccgaaatggatggggctaggcaacgggagcccatgggatattatgcagacatggttcggtgctccaaaccgctacggagtagacgaaaaaggggaactcattccggacttcacaacagaagaatatatggaagcgctgcgttttttcaaaaagctgtatgatgaggggctgatcaataaagacttcgccgtaatggattcagcgaagtggaacgatccggtcgtcaaagggaaagctggtgtgatcgtcgataccggttcgcgggcatcgcagatacaaagcgcaatggaggaagccgatcccggaaacaaggatgtgatcgatgtcatcggaacggtcaaaggcccgaaaggaacgtatacattcccgacatcaggatacgccggaatgattgccatcccgaaagcgagcgtcaaaacggaaaaagaactaaaagaagtgctcggcttcttggacaaaatgaacgatgaagaggcacagatcattgccaataacggcgtaaaagggcgcaactataagcttgaaaacggtgcgtacacgtcccttgaaaaaaacaacaaaaaactgctttacgagcacgagggtcttgcgcagttcagcatgggcattccggaacaaagatactatgtggaaaagcaagaatcaaagctgtttaaacaccgtgaacagattcgcaaagaaggggagaaaatcgccgtattcaacccggcagaatcgctcgtttcagatgtatacacccaaaaaggggcacagcttgacaacatcatcctcgatgccaaaacacagtttatcatcggcgacatcgatgaaaaaggctttcaagacgccgttgagctttggtataaaagcgggggcgaagatttgatgaaagaactgaacaaacgctacaaggagactaaatagctcaggtctttaaacagcacacgaaaggggggatgcggcacatggaaatcaccgcaaaaacagggaagcccgctgttaagacagaaaagaaaccgactgggctagaggccgtaaaacgggataaatggctttatcttctgcttgttcccggtgttttatattttctcatatttaaatattggccgatgtggggcgtattaatcgccttcaaggattattcgccttatctcggattttggcagagcgaatgggtcggattcgagtattttaaagatttctttatgaatcctgacttcttccgtctgctccgaaacacgcttatgctggccgctctcgatttgatctttgcatttccggccccgctcattgtcgctcttttactgaatgaactgcggcacgccatctataaacggtgcattcagacgtttatatatgttccgcatttcgtctcatggacgatcgtcgtcagcataacgtttgtctttttcacggttgatacgggcgtgatgaataaagtgctgcaaagcataacgggccgagagattgcgtttctctcagatcccgaatggttcaggccgatgattgtgctgcaaagcatatggaaggagacgggctggggaacgatcctgtttctggcggcgctcgcttcggttgaccaagagcagtatgaagcggcagtgatggacggtgcaggaaggttgaggagaatgtggcacattacccttccggccatcagaagcacgatcgtcgtgcttctcatcttaagaatcggcagctttttgaacatcggcttcgaacagatttttttaatgaccaattccttaaaccggagcgtagctgaaatcttcgacacatatgtctatgttgtcggaatcacgcagggcgcatacagctacagtacggcagtcggtcttttcaaatcggttgtcgggatcatcctgatattctgcgccaactatatcgcgaaaaagtttgaccaggacggtctgttttaatgaatggaggtgaaagggatgtccggtgcggaaacgatccataacacaaaagcgggccgggtgttcgattggtttaatgtgatctttctcggctgctgcggactgataaccgtcttgccttttctgtatattatcgcggggtcatttgcgacggaggccgagctggcggaaaggagcttctttatctttcccgagacgttctcgcttgacgcgtaccgctatattttttcaacgccgacatttatcaggagcatgggggtgtctgtgcttataacggtcgtgggaacgatcgtccagctcttttttacatttacgatggcctatcctcttgcaaaacggcacatcaagggaaggaatctgcttttgaatctcgtcatttttgcgatgcttttcagcggaggaatgattccgacgtatatcgtcgtcaaatcactgggactgctcgattcctattgggcgctgattttgccgatggcgatcaacccgttcaatctcattattattaaaaacttttttcagcagcttccgaaagagcttgaggagtcggccaagattgacggctgttcagaaatcggcgtgttcttaaggatcgcactgccgctgtctaagccgattattgcgacttttgcgctgttttatgcggtcggcatttggaacgactttttccatgctttgctgtacatcaatgacagtgcgaaatggccgctgcaaatggtgctgcgccaagtgacgattctttcggatctgacggggacgacgaatgatatgatggaaacggtgccgcctgaacaatcgatcaaactggccgtcatcgtcattgcgacgcttccgattttagccgtgtacccgtttttgcagaagcattttgccaaaggcattctgatcgggtctgtgaagggataaaaaaaaaccgccgggctcatgtgccggcggcttcggctcaggcagctgagccgtttttatttctttttttcatccaaaaataaaccgggagaccgacgagaccgatcaagatcgaccacaggcagctgtagaagtctgtgatgagcgtgctgacaaggacaaacaatgacccgagaatcgccgctacaggcaggtaaggatagagcggcacgctgtaagatcttccttggccgttcttccgtctccgcaaaataaataccgcgaaaaacgccatgacatagaagatgtaaatcataaaaatcgaaacctctgacagcttttcaggattgctgatgatcattaaaatgacagcgataatcatctggacgatgactgcgatccaaggcgtatggaatgccggatgaacatgcgagatccagcgggagaaaggcagctgttttttctcagccatcgcaaagatcacgcgcggaaaagacagaacctttccgtttaagcagccgaagatgctgacgataattccgatggatatcagcttgccgccgagcggcccgaacagcatggtcgcggctgtgcttgtcgcattttcgccgagcttgacaatctgatcggcaggaagaatgtgaagcagcgccaagttaatgaacagatagcaggcagtgacgatcagtatgccgcctgtcatcgctttcggaagcactttttccggattcttcatttctccgccgagtgctgcaagaaggatccagccgtcatacgcgaatagcgtcgccaataccgccgccccgaagttttggctggcgatgctctccgtgaccgaactgaaaatatattcatcgccctgccatagaccgaacacaatgatacatacaatgggaatcagctttccgatcgttgtgatcgtctgaaccgctccgccgtattttgttccgacgatgttgacgatgcataaaaaggcgacggtgatgatgccgatgagtgcagtccaggatttatcccaggaaaacaagttggccacaagcgagccgaaatataatccaagtgcgccgatgatggccggtccgtagatgatgatctgcacccagccgcataagaagccccagaactcgccgtaaatttcttcaagatatgtgtaaagaccgcctgttttcggaatctgtgcgcccagttcagcgatggtcagcccgccggcaagcgtcaagattccgccgagaagccaggcgaaaagagcgatttgtgcgtttccggaataggaaagcacgctgccgggcttcataaacacgccggaaccgatgatcgttccaatcacaagagatagcgcaaataacaagcctatctctttttttagtccgtttgcttctgcattcattgctatgcctcccattgatgtgatctctttcatagaaaactatttttatattgtaataccttttttaaaaaagaaaaattaaataaattttctgattttcgtatttcttgtatatgttaaacatttcaaggtcgtaaaccccgggataaccatcaataaccgaactttaatatatgatttttgatatattgttagtttttataggagagggagggaggcccgaccgggaagacggtttggttgacttttcaaatcaaatcgcctattttggagaaagaataaatctcgaattcgagatatttaattgggagatgatagaatgaacgtaaatggcattcaccacgtatctgctttaacagcaaacgcccagcataacctggatttctatgtcaaagggcttggcatgaaactgataaagaaatcggtcaatcaggacgatccgaccatgtaccacttgttttacggggatgaagtcgcgtctccgggttcggatttgacatttttcgagattccgatgcttgcccggagacgggaagggacgaactgtatttcggccgtatcacttcgggttcccggtgaacaagcactcgaattttgggagaagcggcttcatgagctcggcacagagatttgcggcatcgagacgcgtgcggggcggagcattctccgctttttagatcatgaaggacagaacatgatgtttgtagctgatgaaaagggaaaagaccatggagtgcctgtgaaaaacggcgtcattcctgaggatgctgcaatcagggggctcggcccggtcgaactgactgtcagggacgccggtccgacggcggcggtgctgaccgatattctcggctttcataaaatcggtgaggaacaggctgacgaatccggccaaacgcttcacatatttgaatcgggtgaaggaggagcaggcacggaggtgcatgtgaaacagtcagatgacggcagaagagagcgtcccggaagaggaagcgtccatcatgtcgctttccgcgtcaaagatgaagaagaacttaagcagtggcatgagataatcagtgagaacggcttttcgaattcagggattgtggaacgctattattttaaggcgctgtatttcagagaaccgaacggcatactttttgaactgtcgactgacggtcctggctttgccgttgatgaatcaattgatgagctcggccaaagccttgcccttccgccgtatctcgagcatcggcggaaagagattgaagcgcggctgaaaccgatccgataaaaaaacgaggtcccgaaaaggacctcgttttttatataggctctgttaaacgtaaatgttgatatttgataactttccataatattggtataatcagatgagaacaaacattcgatgagaggctatcaaggtgagcgaagcgtttgcaacttgttaaagtatatcggcaaattaccacgagctgaaaaagaacaagtgtaccaatgggttaaacgctatgctgaaccttcttccattgttggtgttcgattataacagagacatatgacagtttgcgactcgcaaaaatgaatgtgcagtcctaattcaaccattcagtaggattgttagaaagcgctgaatagaaatttataaaatgttgggttattaaaaatgaaaagtgaggtttgtatatgaatactgtcagccaagaaatccaagatttgtccattaaatctttggaatcaacttttaataaactaacaaatgcttataaaagcacgacagaaaaaggttcaaacacaactcttgtcaaaaagagactaaacgcagtgaaaattggtttagaaagcctaaaaggtacttggtatggagaagatttcggctataacgaagaaatcatattgactactaaaaaagttttaaaaggtatcattccatctattgaaaaacaaatagcaaaagcaaaagaaggcagtcctcaaaaaacattaaatgagcgtcgcctgactgcactaaaactggcaatcgaatctttggagaaccgtcttatataagacggttcttaaattgtttcagaatcgtgtgagttacataacaagattgaaggaaaccgtttttactacggcttccctttatttttgcgtatttaacaacatccaaatctaacagagtctttatataaaaggcatccggcacagccggcggccccgtaaaggggggcatgctgttaagatgatgcggattctttctggtcaagggtgatttgttttgtcatggttttgccgtttcgaatgagggtaacctttaccgtatccccgatttttgcatcgttgtaaagaaggttgcgcagcgcgcttcctgtatcggtttcttttccgttaaagctgacgatgacatcgttctctttaaggcccgctttttcagctggggagcctgaagcgacctggcggatgtagacgcctttgtttaactggctgccgcttaatccgagggtgcctgtttgatagttttccggcacctgctcaagatccatcatgccgattccgatgaacgggcgctcaatttttcctttagacatcagctcttctgcaatcggtttgacatcattgcttggaatcgcaaatccgatgccttctactccgctttcactgattttcatgctgttgatgccgatcacttcaccctttgtattcaaaagggcgcctccgctgttgccggggttgatggccgcgtcggtttgaatgacgttcatctcggtttggcctgcggatgtatctacggaaacggtccgatcaacaccgctgatgatgccttgtgtcaccgtgcgggacagatctttgccgagcgggtttccaatagcgatcaccgattcgcctgctttcaagcttgacgaatcgccgaaagaggcgactttttccacgtgatcagcggaaatttcaacaacggcaaggtctgtcaacgaatcgctgcccagcaatttaccttccacttctttgccgttggacagggaaaccgtcagtttagacgcgccttcgacaacgtggttatttgtaataatgtatgctttgccgtttgcttttttatagatgacacctgagcctgtgcctgtttcttgttcgcttgagctgctgctgttgctttcaaaaccgaacataccgctctctgtttgtttttgatagtttgaaataccgacgatggcgggagatacattttcaaccattgtagaaatgtcggacgaattggtgctggacaatttttcggtattcgctttagtggaagaagccgatgagttcgacgtctcgtttgtttgcgtctggacggatgtattggccgtttcgtctttgctatgctggtatgtcgtgacgccgagaacgaggcttcctccgatgatgccgctgagaatcggcgtcatccacgagagtctccgcttttgctgttctgctttttttatcgcctggtcgggcttttgatcggagacgatgagttcgttttttgtttcaagctgatcttctctattatattccatcattttcacgctcctattgctatcatatcctttgatgccttaatcataaacaaagactgtgggataaacatgaaaacattgtgggaaattgtcaaagaaaaaggatagaatatatagggtgctatttataatatgacatgtcagaggtgttctaaacgttgaacaagattggatttatcggatacggaagcatggcccggatgattgcggtgaaactgctagatcaggggaaaatcagggatgacatggtggtcgtcagctcaaggaatgacgggaaaacagaggagctgaaaaagctttatccgaatgtcgcctgtcaatcagctgatgagctcgccaaacagtgcggcctgatcttcatctgtgtaccgccgatggcggtaaaagaaacgcttgaaaaaatacagccgtttcttcaggaggatgtccacatcgtttcgattgccgcgggggtcgagcttgaccggcttcacgactggacaagcggacaggtgacgagatacattccgacactcacatctgaagccgggatcggcgtttcgcttgttgtccacggcgagcgggtcgctgaggcggacaaaagccggctggaagaatatctttccgccttcagcacagtcaaacagatcaatgagagagatattgacgctgcgagcaatttaacaagctcttcaccggggttcatcgcttcgatttttgaagaatttgctcaagccgccgtcagaaacagcagcctcacgaaagaagaagcgtttcaatttctgattcattcattgctgggaacaggcaagctgttaatggaaaaagacatgacgtttgctcaaacgcttgatcgggtggcgacaaaaggcggcataaccgcagaaggtgcggaagtcattcaagatgccatgccggaagtctttgacgagctgtttgccagaacgatgaagaaatatgaagtcatcaaagacgctgtccgccggcagtgaaccgcggcattcatcgacatatccggatatccgcaagctgcctgaccaggcagcttttttatttgcattcgacaacattcatcaaaattccaattttatattaaatttctaaaattaccaattgttattgcatttctattaaaattctaatataatttgttagaatattcccaaaataataaaaaatttgagacgtttttaaggggtggttttttgtgaagctgtatatgtctgttgatatggaggggatttccgggcttccggatgatacgttcgtcgattcaagcaagccgaactatgagagaggccggaagatcatgacggacgaggccaatcatgtgattgacgaagcgttcaaaaatggatgcagagaggtgattgttaatgacagccactctaaaatgaacaacctgttaattgagaggctccatcctgaagcgcggcttatttcgggagatgtcaagccgttttcgatggttcaggggcttgatgatacatacgacggagccgtgttcgtcggctaccatgcgagagcgtcgatgagaggcgtgatgtcgcacagcatgattttcggcgtcagacatttttacatcaacgatcaggcggtcggcgagctggggttcaacgcctatgttgccggttattacggcgtcccggtcatcatggctgccggtgacagcgaggcggcagctgaggcggaggagctgattccgaacgtaacgacagcagccgtcaaagaaacggtctcccgttcggcggtcaaatgtctgacgccggagaaagcggggcggctattaagagaacggatggcatatgcgattcaaaaccgcggtcaagtcaagccgctcacacctccggacaggccggtgctgcggatagaatttgccaattacggccaagccgagtgggccagtctgatgccgggtgctgaaatcgaaccgcaaacgacgactgtccgctatcaagcgaaagacattcttgaagcctatcaagcgatgcttgtcatgaccgagcttgcgatgagaacgacattctcctaggaaggtgggatgaaaatggcgggttacatcatgaagcggctgctgtggatgctggcaaccattttggtgatcacgacattgacctttgtgatgatgaaagtgattccgggctctcccttcaatgaagaaagaaatacgaacgaagcggttcagcgcaaccttgaggcttactatcagctggatgagcctctctttgttcaatatttgtactatgtaaagtcgatcgttacctttgatttcgggccgtcgatcaagcagccttcgcaaagcgtgaacgacttgctgtcaagaggatttcccgtttcgtttgagctggggatgacggcgcttattgtggcggtcatttccggaatcgcactcggaatctttgctgcgctgcggcaaaacggcatcatcgactatatagcgatgaccattgccgtactcggcatttcggttcccaactttattatggcaaccttgctgatacagcaatttgccgttaattggaacatattccctccgtcgacatggacgagcccgcttcatatggtgcttccgactgcggctttggcgatggggccgctggcgattatcgcaaggctgacccgatccagcatgatcgaagtgctgacgcaggattatatccgaacagcccgggctaaagggctttccccttttaaaattgtcatgaagcacgccctgaaaaacgcccttatgcctgttgtaacgattctcgggacgcttaccgctgcgattttaacggggagcttcgtcatcgaaaaaatctttgcgattccgggcatgggaaaatattttgttgaaagcatcaactcccgcgattaccccgtgattatgggcaccaccgttttttacagcatcatcctcatcatcatgttgtttctcgttgacatggcctacggaatactggatccgcgtattaaactgcataagaaagggtgagcttatgagccttccagtccgcacagaaaaagaagcgtcttcaggcagtgatatccctgttgaatggtttgccccgctgaaacagaagcaggatgagcgtgaatccgtcgcaaggccgagtctgtcatattggcagaacgcctggcggattttaaggaaaaacaagctggcgatggcgggattgggcgtgttaatcttcctgttcttcatggctgctctcggaccggttctttctccgcacagcgtcacccagcagacgctatccgagcaaaacctgcctccgtcgacggagcattggttcggaactgatgagctcggacgcgatgtgtttacaagaacgtggtacggagcgaggatttctctgtttgtcggtgttatggcggctttgatcgattttgcaatcggcgtcatctacggcggcatcgccggctataaaggcggcaaaacagaccacgccatgatgcgggtcatcgaagtgctgcacggactgccttatttattggtcgtcattcttctcatggtcatgatggggcctggactcgggacgatcctcgtcgcgctgactgtcaccggctgggtcggcatggcgcggatcgtcagggggcaggttttgaaggtgaagcatgatgagcatgttctcgcatccaaaaccttcggagcgaaaacggtaaggatcatcaggcggaatctgcttcctaacatgatgggagcgatcatcgtccagatgaccttgacggtgccgtcggccatttttgccgaggcatttctcagtttcctcggtttgggcattcaagccccgtttgcgagctggggtgtcatggcgaacgacggccttccggtgatcttgtcgggacactggtggcggctgttttttcccgctttctttatttcattaactatgttcgcctttaatgttgttggagacggactgcaggatgcgttagatccgaagctgaggaggtaatgtatttttgcggaaaaaagtattggaagtcgagaatttgcatgtttcatttacgacatacggcggaacggtcaaagccgtccgcggcgtgagctttgagttatatgagggggagacgtttgcgattgtcggcgagtcgggatgcggaaaaagcgtgacatcgcaaagcatcatgcggcttttgccgaagttttcggcaacggtcacagacggtgcgatccgctttaagggaaaagacttgcgccacctgtccgaaaaagagatgagaaagatcagaggagccgaaatctcaatgatcttccaggatccgatgacggccctgaatccgaccttgaccgtcggagaccagctggcagaagcgctgttggaacatcggcccgtgtctaaaacagacgctcgaaaagcagtcatttcgatgcttgagctcgtcgggatcccgaatccgaaagagcgtttgaggcagtatccgcaccaattcagcggagggatgaggcagcggatcgtaatcgccatggcgctcatctgcgaaccggagattttgattgcggatgaaccgacgaccgcgcttgatgtcaccattcaggcgcaaattcttgagctttttaaagacattcagcggaaaaccggggtatccatcattttaatcacccatgatttgggcgtagtcgcacagacggcagacagaatcgccgtgatgtacgcagggaaaatagctgaaacgggagcgaggagggatattttttaccgtccgcagcacccgtatacaaaaggcttgctgcactccgttccgaggcttgaccttgaagatgcagacctcgttccgattgacggaacaccgccggatttgttttctccgcctgaaggatgtccgtttacggcgcgctgttcccgcgcaatggaagtgtgcggcaaaatccatcctgccgttacagaagtctcggcgggtcatcgagtgtgctgctggcttcaggatgaaagggcaaaaagggctctgctgacaacataatcataaaatcgatttttcaaatggggggatttgatgaaaaggctgacgagcgtgttggcttccgcatttgcggtcatcctgctgttcggatgtacggcaaatgaacaggcggggcaggaaacgaagaagaaagcgaaagaaacggctggagaacaggttctgaggctgaacaacgaaaatgaaccgacatcttttgatccgccgatcggctttaataatgtctcatggcaggcgctgaacaatctgatggaaggtttgacaagacttggcgcagaccatgagcccgaagcggcgtccgccgaaaagtggaacatttccgacgacgggaagacatatacttttacaatccgtgatgatgccaaatggtcaaacggagaccctttaaccgccggggattttgaatatgcgtggaagcgtctgctcgatccgaaaacgggctcctctgccgcgtttttaggctactttatcgaaggcggtgaggcctttaacagcggaaaaggttcaaaagatgatgtcaaagtcaaagcggtggatgaaaagacgcttaaggtgacgcttgaaagtccgcagcagtcgtttttaagcattgtagccaatccggcctttttcccggttcctcagaaaatcgccgaagacaatccgaaatggcatgaagaagcagccacattcgtcggcaacggtccgtttaagctggcagaatggaagcacgatgaaagctttacgatggtaaagagcgatacgtattgggaccgggatactgtgaagcttgataaagtgacatgggcgatggtcgatgaccgaaataccgactaccaaatgttcgagtcgaatgaacttgatacggcttatgtcccggctgaaatgagcgagaagctgatgggctctgatgaggtgaaggtgtttgatcaggcgggtctttatttttacaggttcaatgtcaataaagagccgttccagaatgaaaaaatcagaaaagcgtttgcgatggccgtcgatcagcaggaaatcgtcgattacgtcacgaaaaacggtgaaaaaccggcacgcggatttgtgtctccgggaatcaaagggccgaacggcaaggattttcgcgaggaaggcggcgatttgctcaaatataacgccgatgaagcgaaacagctgctcgaaaaaggcatgaaggaggaaaactacgaaaagctgcccgccgttaccttgacatacagcacaaaaccggagcataaaaaaatggcggaagcggttcagcaaaaactgaaaagtacgctcggcgtcgatgtgaagctcgccaatatggaatggaacacattccttgaagaacagaaggcgctcaagttccagttttcccaaagctcttttctggctgattatgcggatcctatcaacttcctggaaagctttcaaacgggtaacgcaatgaacagaaccggctggggcaattcagagtatgacgagctgatcaaggcggcgaaaaatgaagctgatgaagaaaagcgcactgagctgctgcatcaggctgaagaactgctgtttgaagggatgccgatcataccgatccacttctataatcaagtccatttggaaaaggagaatgtgaaaggcatcgtccgtcatcctgtcggctacattgaactgaaatgggccgaaaaaacgtcatgaccaaaattgtccgtctgctattttctttgtgcatactgccgcacaggagcggacggacttttcataaagggggatgtctctgttgaatattgcgcctcaaagattaatgaagggagatacggttggtgtgattgcgccggccagtccgcccgttcctgaaaagcttgaccgggccgtccggtttttaaaagagcttggacttgaagtcaaagtgggacgctcagccgccgaaagacacggctatttggcggggagcgatgaagagcgtctgggggatctgcacgacatgtttgaagaccgttcggttaaggctgtcatctgtgcctgcggaggttacggaacggcacggattgccgggaaaattgactaccggctcatcaaaagccgcccgaaaattttttggggctattcagatatcacttttttacatacagcgatcaggcaaaataccggacttattacatttcacggaccgatgctcagttctgacatcggcaaagatgacgtgcatccgcttacccgccgctcctttcagcagctgtttcaaaaaatgacgctctcttatacagaggaactgtcgcctttggaaacgctcgtacacggcgcggcggaaggggagctcgtcggcggaaacctcgctcttctggtgacgacgctcggtacgccttatgaaattgatacgaaaggaaagcttttgtttatcgaggatgtcgatgaagagccttatcgaatcgaccggatgctgaatcaattaaaaatggccgggaaattatcggacgccgccggcatcctgctgtgcgattttcataactgcatcccgaaaaaacgcgataagtcgctcacattaaaagaggttttccaagattatatcgcctctgaaggaaaaccggcgctgtccggctttaaaatcggccattgttcaccgaatatcgccgtaccggtaggggtgaaagccgtccttgacgccggcaaaaaacggctcaccatcgaaccgggaatttcttaatgggaaaggaggccgccatgaagattgccgagattacgacaaaccgcatcgccgttccgctgaaaaaaccttttaaaacagcgcttcgaaccgtccgcaccgcagaagccgtcattgtcaaagtaacggctgaaaacgggatgacaggctggggagaagcgcctccgactgctgttattaccggtgagacgcttgacagtattgagggggcagtcaacacgattctcgcacccgccctcaccgggtgcaacttgcgaatggctgaggcgatatttcatgatatcgacaagctgattgttggaaatacaagcgcaaaggccgctgtagaaacagccgtctacgattgcttggcgcagctttgcggtcttcccctgtatcaattgctgggcggatacagacgggagatcgagacggattttaccgtcagcgtcaatgacccggaagaaatggggaaagacgcggcccgctatgtacaggaagggtttcgcacgctcaaaattaaggttggaaaaaacgacatggcaacagacctcgaacggatcagggaaatccgcaaacaagcgggtcccgctgtccgaatccgcgtggacgccaatcaaggctggacggcgaaacaggcggtcaaagccattcggaaaatggaggatgaggggctttcgatcgagcttgtcgaacagccggtccaccggctcgatctcgaaggcttgaaacaggtgacagatgccgtcgatacgccgattatggcggacgaaagcgtgtttaccccaagggatgcttttcacgtgctgaaaacgagaagcgccgatctcatcaatattaaactgatgaaggcaggcggcatccgccaggcgctgaaaatcaacgccatggcagaagcgtgcggagtggaatgcatggccggaagcatgatcgagacaaggctcggcatcacagcggccgtccacttcgcagcaagccagaaaaatgtgacaaaattcgattttgatgcgccgctcatgctgaaggaggatatcgttgaaggcggcatccgctatcatgcaggaacgatcacgataccggatgctcccggactcggaatcacgaaagtctgccatgaggggggagaggacaaatgagcctttatacgacagcagtctcagtcgccaatgtctggaccagtccggaagcgccgcgcacaattgaccggatgatgctgtcaaaccctgtacatgtgagaagctggcttgacgaattgtcctacgaggagcgccttgagctatgtacggcaaaccttgttcaaacgcaagtgcttttcggcgaagatgtccaacttataaaggagcggggagactgggcgttcgtcatcattccgggacagccgtctgcaaaagacaaacgcggctacccgggctggattccaaaggactgcctggtcgaaaaaagcccggcgaagtctgagacaagcgccgttattcaaaaaccgacggctttcttatatgatgacaagaaaacgaaagttattgagctgagctttctcaccaagctgcccgtcttgtcttccggcggcgtctggtttgaggtcgatacaccgcttggccgcaaatggctgaaaaaagaagatgcggatctcgaaacacctgtaaaaggcagcggagacgatatcgttcaaaccggtcaggcgtttttgaacctgccctatctttggggagggatgagcgggtttggctacgactgctcaggatttgtcttcaatatgctgaaggcgaacggctgctccgcgccgcgcgatgccggcgaccaggcgaaaggcggaaaagaggtatccttcagcagcccgaagcggggcgatttactgtttttcgcatatgaagaaggcagaggacgggttcaccacgtcggcatttactgcggaaacggagagatgcttcactctccaaaaacgggcaaatcgatcgaggtcatatctcttaaaggtacaatttatgaaaaagagctgtgtgccatcaggcgctatttttaaataaaacggggggattggcatgcaaaccggcgctttattgaaagtcagccgtctgaaaatgcactttgacgccggaaggggcaaaacggtcaaagcggtcgacggcatttcatttgatattaaagaaggagagacgttcgggctcgtcggagaatcgggctgcggcaagtcgacatccggaagagtgctgatgcgtctttatcagccgacagaaggcgaggttacatatcgggggaaaaacatccaccatttgagcgatgatgaatcattccagtacaaccgcaaaattcaaatgatttttcaagacccgtatgcttcattaaatccgaggttaaccgtcagggagattatgacagaacctatggaaatccacggcctctacggagggaaaaaggcgcgtcttgaaaaggcggacgagcttctggaagcagtcggtctgcacaaaagctttgccaatcgctatcctcatgaattcagcggcggacagaggcaaagaatcggcatcgccagagcgcttgcgcttgaacctgaattcatcgtcgccgatgagccgatatcggcacttgacgtctccgtgcaagcgcaggtcgtcaaccttttaaaaaagctgcaaaaggaaaaagggctcacgtttttatttatcgcccacgatctttccatggtgaagcacatcagcgaccggatcggcgtcatgtatctcgggcacatggtcgagatcaccgacagcggccggctttatcaagaacctctgcatccttacacccaggcgcttttatcagctatcccgattcccgatccggatgtggaagacaagcggagacgaatcatactgaaaggcgagctgccaagtccgatcgatccgccgagcggctgcgttttcagaacgaggtgtcctgccgcgatggacatttgcgccgccaaaaagccgatgttaaaagaagccgacgacggtcattttgtcgcctgccatctgtatgacggagacgcaaggaaagaggaggccggcttgaaggtgacgctgcaggcgaggtgattatagaaaaaaggagccctatttacagggctcctcagcgtgccggcagcttttccacatttgttaagtcgccgattcgaaatggaataaggatcaggcgccgcctttgtaacattcagtggaagtacgctcaatcggcagagtacagcatctgaatgatccgcctgattttatgatctcggataagtcgatttcgatgaccgtatagcccctttttctgagctcctgattcacgtggcggttaacaggcaggctgatcacggttttattgccgatggacagaacgtttgtaccgagttggaactgttcatcatccgtaatttcgatcatctcatagcgctttttcaagacgtcgtattctctttctcctaaggcttttggatagacaagcgcttctgtcggcgaaagaatgttgaagacgcaatccagatgaaggaacgtttcttcaaacggaaccggtatgacttcataagagggaagcctgcgcttcagctcttggacggccgagaacgtcgttctgtggctgatgccggcatatatggtattttggtcgacgaggatgtcgccgccttcgatttgatagccttcattaaatgcggtccaggagatttgttcttttgccagccattcctgcaggacattttcttcgccctggcggatgtcggctgaaagctgcgcggaaaacacagtgcctccgatcgtaaacccgatatcgcgcgtgaaaacctgttccggaaattggcttaaagcaggcagaatcacgacttcaataccccggctctccaattcttttatcaatgtattatgctggcggacggccagcgttttatcgatattatccttttgaaaatacttctgtgtttcattgatcacttctgcaatctccatatactccggtctgcataacaccactttttttaagacgtcgtattcgcttgtacagcccgccccgcggttttttttcgataatgctgagtccattttgattcccccgtcctctctttagtcatttcattattccctacccgcagcgggaaataaaccttttagccagaaaatctgacagtcagccggataaaaaagtttagacaaatgaattctaatagtgtttaatatagaaaaaatccactttacaaacgcatcttagtagacatcaaaggagtaatggatgatgaatggacctgaaaagagatactgcaaagattcaaaagttgtcaaaacaagcagggtatttccgcttgatacgaacaatcacaacaccttgttcggcggcaagctgatgagctatatcgacgatatcgcttcgatttcggcagcgagacactcgaggtgtgaaaccgtgacagcttcaatggattccgtcgattttctcgaaccgatccgccaggaggattcagtctgccttgaatcttatgtgacatgggtcggcagaacgtcaatggaggtattcgtcaaagtcattaaagagcatttgctgacaggcgaacgaaagcttgcggcgacatcctttttaacctttgtggcgcttgatcaggacggcaatcctcaggccgttccccaagttgtaccgcagtctgaagaagaaatcatgctgcacgagaccgcccggcagcgcgccgaagaacggaaaaaccatcgcaaacacagcaaagcgctggcccaggcgctggctgttgacaaaccttggtaaacatacgaacaaaaccccggctcaagcatcagtttgccggggttttgctgtgcaatgaatacactacccaatatttgttcaaaataaattacaaaaaacggaaagaagttttgggtgaaatgcttgaatttgtatggacttttttagccaagccagctttagtgttctctatagcttatattcttttccgaatcgcagggaagaaagccgtttcgcaaatgacgaacttcgaccttttgctgacatttgcgattggaacgatcatcagcgaaccgattcttacttctaaaatttcaatgtccatttattacgcgcttacctttctgatcttctatttgttgattgaaaagctgtcattacacaataaatggcgatggtttcttgtcgtcagtccgaccgtgctgatccgaaacggcaatattgataaaggaggattaaaaagagagcggctgactgtcaatgaactgctcggcaaattgcgcgaaaaaggctatgccgacccaaaagatatcgacctcgccctgattgaagaatcgggccagatcagcgtgattcccaaatcggaagcaaggcctgtacagccgcgggacctcaacttggagacgaagcggaatttcgtgccgattccgctcattttagacggcgaaattatcgaacacaatttaaaatacttgaaaaaaacgaaagaatggctgtttcaaaaattagaggataaagggattgagcaagcgatgctgccaaccattacgctcggcaccttgaacgaaaaaaatgaaattataattgatacggaagatcccggcagcccgttaacccatgacccgtatctctataaaccggggcaagaccattaattttcgccgaataggcgatttttttatttcctgctatttcagaaaaatattaagagtctgtttttttattcgttgataaaaatgaacagggcatttgtcataaaatttgaaaatggtgtcacaaaaaacaggaggaaaatatgttgttttctgtatttttatagcatatattagtttttgtgaaaaaattttgatgataggtgcaattgatgaaaaggttttttagtgtaataattttgggcgccctgctgctgctcgggacatctgcgccaatcgaagcggcagactacggacgcgacgtcctcggctcaaaagacggctggggcgcttatggaaaaggaacgaccggaggcgctgacgcttcttctgatcaggtatatacggtcaaaaaccgcaagcagcttgttgaggcattagggggagacaataaaaagaacagcgaaaatgatacgccgaagatcatctatgtgaagggaacaatcaatcttagtgttgatgatgacaacaatcctttaggctatgaagattataaagaccccgaatattcgatcgaagcgtatctcaaagcttatgatccgaagaaatgggggaaaaaggagccgacaggaaagcttgaagaggcaaggctccgctcgaaagataatcaaaaggaacgggtcttgatcagagtcggttcgaacacaacgattatcgggctcggagatgatgcgaaaatcgtcggcggaggcctttatgtcaaaaacgcggaaaacgtcattatccgcaatatcgaattcgaaaacgcgtacgatttcttccctggctgggatccgacggatgggagcagcggtaactggaattcagaatatgacaacctgctgatcgaaatgtccaaaaatatttggatcgaccactgctcattcaatgacggagatcagcctgatgagctgactgaaacgcatttcgggcgcgaattccagcatcacgacggactgcttgatatcaaaaagcagtcggatttcattacggtgtcatacagcatattttcaggacattctaaaaacacgattatcggatcaagcgacagctacaaagcagacaacgggcatttaagggtgacattccaccacaatctctacgaaaatataaaagagcgggcaccgcgcgtccgctacggaaaagtgcacatttacaacaactattttaaaagcacgaaagacagctacaattattcatggggcgtaggctattcttcaaaaatttatgctgaggacaactactttgacctgccggaaggaacgaagcctcaaaaactgatgaaggtctttaaaggtgacgctttatatgaaaaagatacgatcgtaaacaaccaaaaaagcgtcgcaaaaattgatgttgtcagcacatacaacaaagcaaacaatgcgtctattaaaaaatcggccggctggaagccgacgctgtttgaaaaaatcgacgacgcagaagatgtgccggcaatcgttgaagcgcacgcaggcgcaggaaaactgaagtaatcaagcaaagcggacatgcagatgatgtccgcttttttgttcaggtatcttgcaatgcaaaatagtgtatgttatcattcgtgtatcttgtattgcaagatacataaaagaggtggcttatgagttcaacgcaaatgctgaaagggattttagaaggatgtctgcttgccgttatatcagaaggggagatatacggctatgaaatgacaaaggtgcttgcgggatacggtttttcggatatcagcgaaggaagcatctatccgattctcctccgcatgcaaaaggaaaaatgggtggagaccgaactaaaacggtcggcgagcggcccgaagagaaaatattacagacttacaccccttggagaagcggagcttcaatcgttcatcgaccgttggaaagcattatccgggaacgtcaatgcactgctcgaaaaaaaactgaaggagaagtgaaactgtgctatcaaaggacatgcaaaacgtattggacgagatgagaatctacttaatgtcttcaggaaaaagcgacaaagaaatcgaaggaatcatgaatgagctaaccgttcatgcctgggaaggagaaaaggacggaaaaaccgtccggcaaatttttggggattctcccaagtcatatgttcaagcgctgtcaaaagagctttcatcaaggccaggggagatcgccaagttgttctttgccattttaatcggcgcaatatcctattttatattcagcgacgccgtgaacgacagcctcgattattctgtctatacgctggcaggctatccgctttatattttgctggcagcggctatgttgccgcttttgggccggattacagcatttaaagggaagaatacggccttcatgtatacgatggtgtacgccgctttgacgttttttccgattttggccattatttttattgaccggcaattcgggacaccggttttttcgtttgatgggggaagccgctggctgattatggccctgtcgtttcttgtgatcgtatgtttgtctttcaggttgaaagccggagccttgtccatattgccgctgcttttagccggaacgcattttttgtttcagtatatgaactgggattcagcaggagccatgatggcagaaacttatattccctatatcgggctgcttctcgtcatgtttattgaaacaaagcgtgccagaaatacggctcaatatgaatgaaatacagaagagcattatattttttaaggtgaagactcttgccttttggcgatcacaacgtttatgatcagagcatgaaaggtggccgatatatggatatgatgtggggctatgtactcgtctttattttggctgcgattccgtggtttgaagtgatcggtgtcgttccgctagcgatcattgccgggcttaaacctgttccgtccgctattatcgcgctattcggaaatctattaaccgtactgctgcttatttttttaattgacaaagtgaaggtatggctagaaagaagacgcggggagcggagagcggagacggataagttctcaaaaaggaaaagcagggcgaaaaaaatatggctgacctacggcattccgggcctttctttcgtcgggcctttctttatcggctcccacttaaccgcgtttatgtgcatgggctttggggccaagcgcagacaaacggcgctgtggatgacggggagtctcgcagtatggacaacggcgtcggctgtcgctgcctactatggtttcagtttcctcgctcctgaaaatgaagggctgctgaaaaatatctttaaacaggaggagtgaagatatgccgtttttgaaagatttatctccagatgaagagatggcgccgacagtcgggctgcttttttcggcggtcaatgaaaacatcgaacggctgaaatcaatcgtctccggcatcagccgggaagagctggaatataagggtgagcatggcgacaaaaacagcatcgcccagctgatctatcatttaatcaatgtcgatgtccgctgggtttacaggctgaaggaaagcgaaattccaagagagctggaagagaaatacggaccgatgacggatgaaaacggacgtttgccggaggtgacaggcgtccctttgaccgtgttaatcgagtggcatgaagaggtgctggagatgttgaaacacaccgctaaaggcttttcggaaaaagacttgctgaagaaggttccgtatgagggagggttttcgacgatccgctgggggatctggcatatgtctgatcataaccgctatcaccaggcgcatattcaggcttgcttaaaagagttccgcatgcaaaacagttgattttttcgtatgatttggtatgatgctaattagcaaacttcataacgttaaagttttctagggttccgcacattcgtatgtggcctggtccgagagaaaacacatatgatttgttcatatgcacacggagggataaaagcccgggagtatcgtttccatcgatagcccgggttttttcttttgctgaaaatgaaattggagggattgtgatgagatggggcagtgtcatacttgcagccttgtttgaaattggctgggtcatggggctgaaacacgccgattcggcacttgaatggatctgcacggcggccgccgtcgtgatgagcttctatatactggtgaaagcgggggagaagctgccggtcggaaccgtgtatgccgtatttaccggtctcgggacggcgggaacggtcgtctgcgaaatcgccttgttcaatgagccggcaaatatcgccaagcttgctctgatcggtgttttgctatgcggcgtgatcggtttgaagcttgtaacaaatgaagagaaaggggaggcgtcataatggaatggatctgcctcatcgccgccggtatactggaaatgctcggcgtgacgatgatgaaccagtttcataaagacaagcgggtgagatggatctttttgttgatcatcgggtttgccgcttcttttttcttgctttcccttgcgatggagacgctgccgatgggaaccgcgtacgcagtgtggacagggatcggcacggtcggaggtgcgcttgtcggcatcctgttttacggagagccgaaagacggaaaacgcatctttttcatcgcgctcattttgggatctgccgtcgggctgaaacttattagctagagtcgggttgatgcaaataggcgttcgtaaattgatttttcaataaactccagtataatgaaaagatagtttacgaattacaagcaaagagggtttttacgaaaatgaacgcatatatgaaacagcagttatcgcaatatcaggaaatcaataacgataaggcccgccttctggtcagctgtccggatcagcctggaatcgtcgccgccgtttcttcatttttatttgagaacggtgcgaatattattgaatcgaaccagtatacgacagaccctgaaggaggccggttctttctgcggattgagtttgaagttcaaggcatccgcgaaaagatcgaacagatgaaagcggcattcgcctctgtggcggagtccttccaaatgacgtggagcatgaatttggcgagcgaactgaaacgcgtcgctatcttcgtttcaaaagagcttcactgcctgcatgaactgctatgggaatggcagagcggcaatttgatggcggagattgcagcggttatcagcaatcatgaagatgcaagagaaactgttgaatccctgaatattccgttcctttacatgaaagcgaacaaagacattcgtcaggaagtggaaaaacagcagctgaaatggcttgaagagtatcgtgcggatgtcatcgttctcgcccgatatatgcagattttaacgcctgattttgtctcggctcatccgaacaaaatcataaatattcaccactccttcctgccggcttttatcggggcgaatccgtataaacgggcatatgaaagaggcgttaaactgatcggagcaacatcgcattatgtgacaaacgaattggatgaagggccgatcatcgaacaggatatcgaacgggtcgaccacagagacaatgtggaagcattgaaaaacatcggccgcacgattgagagaagcgttttggcaagagcggtcaaatggcacttggaagaccggattatcgtgcatggaaacaagacgatcgtctttaattaaattgtttgatctgcctcttgacagaggcgtttttcctaggcataataataaaaaatcacgagcgttgaagagggccagtaagcagttctttctgtgaaagagagtgaaatggcatgctgaaacatttcaccacatgaaacctgccgaacctgcctcggagtcccagggggaaaacctgggcgcataccctggcgttaaaggggaaagaggagtgcgctttattttctcgcgcattcaatgaaggtggtaccgcggaaagctcttttcgtccttttttacttggacgaaaagggctttttttattggccttctgccagatcatctcggagggaaaaaacgtgaaaaaacaacggattgtcattaaaatcggaagcagttcattaaccaactcgaagggcagcatcgatgaggagaagatcaatgaccatgttcgggcgatagctgctctgaaaaaagaaggccatgaagtcatcttcatttcgtcgggggctgtcgctgcgggatttttacagctcggctatcccgcaaggcctgtgacgctaaagggaaaacaggctgcagcggccgtcggccagagcttgttaatgcaaacatacatcgagcattttgcagaccacgatatcaagcctgcgcagatcttattgacgagaaacgattttgccaaacgggagcgctatcgaaatgcatatgcgaccgttatggaactgattgaacgggggcttgtcccgattattaatgaaaatgattcggtatctgttgaagaattgacgtttggggacaacgacatgctttccgcccttgtaagcggactgattcatgccgacaaactcatcattttaacggatattaacggcctctatgactcgaatccggctgaacatcccgatgcccgccgttttgattacattcccgaaattacggacgaacttttgggctgcgccgcttccgccggatcaaaagtcgggacgggcgggatgaagtcgaagcttttggcggcaaaaaccgctctttcactcggcgtcaatgttttcataggcgccggagagggagatgataagctgatccagattttaaaaggaaacggggacggcacctatatcggccaatccgacctgtcttccgtcaacaatcataggcagtggatcgcctttcattcacctgtttcagggaagattaccgttgatgaaggggctgagctggcgattaccgaaaacggcgggagcctgctgccggccggcgtaacagcgatatccggagattttccgaaaggggcggttgtcgaagtttacggaccgaacggcttggccgggaaaggccaaacgctgtactccgccgcagagcttgaagaggtaaaagggaagcgaagcgatgagttccatcatgaagaagggatagaagtcatccatcgaaatgattgggtaagcattaaagaataaggggatgaaagaatgagcgaagtgattgaaaaagcaaaaaaggccaaagtcgcaaaggaagaactggttcatcagccgactgaaaggaaaaatgaggcgctttcctttatcgccgaggccatccgctttaagcaggatgagatattggcagaaaacgagaaagatatcgtccgcggcaaagaaaaaggcttttcgcctgcgctgcttgaccgccttgccttaacgccggagaggctgaatgatatagcagacgccgtcatgctgctcacaaagcttgaagaccctgtgggggaaacgcttgaaacgatccgcaaagacaacgggcttttcattgaaaatgtcagggtcccgctcggagtcgtcggaatgatctatgaggctcgtccgaatgtaacggtcgacgccgcaaccctttgtttgaaaacgggaaatgccgtcatcctgcggggcagttcgtcagccatcaacagcaataaagcgctcgtccgcgtgatcagggaagcgctcgaacgctcggcgcttccagaggatgccgttcagctcattgaagatacaagcaaagaaacggcaaaacagctgttcactttaaacgacggcttggatgtgctcatcccgagaggagggaaaaacctcatcgatatggtggtgcgggaatccacagtgcctgtgcttgaaacaggcgcggggaactgccacatattcattgatgaatcggctcagccagacatggctgagcaggttgtaatcaatgccaaaacgcagcgcccttctgtctgcaatgcgattgaaacggtgctcatccataaaggctgggcggaagagcatacgaaagcgcttcttcaaaagcttgaagaagcgggcgttgaaatcaggggagacgaagccgtatgcacgatgctgccttctgcggttccagctcgcgagaccgactggggaaccgagtttcttgcgccggttgtcagcatcaaaaccgttgccggaatcgatgaagccatccggcacatcagacagtacggcacacgtcattcggaagcgattctgactgaaaatcaggaaaacgcccggtatttcttaacgtctgttgacgctgcagctgtttaccacaatgcttcaacacgttttacagacggctttgaattcggctacggcgccgaaatcggcatcagcacgcaaaagcttcacgcacgggggccgatgggccttaaagcgctgacttcttctaaatatatcattaaaggaaacggacaaatccggatatgaaagtgtggcatcctgtctcgaatgaagacaggatgttttttgttgtgttatcacttttaattttataaaattaaattgttcacaatataaattaaaggagacgataaatcatgaaaccgctatttacctcgcaagccactgccaatggtggcagagacggacaagtcacctcatctgaccgcgtccttgagctggagctggccatgccgggaacgccaaaagccaaggaaaacgaaaatgccaccaacccggagcagctgtttgccgccggatacgcggcatgctttgacagcgcattgcaattgaccgcccaaaaggcgcgtcttcgaatggagacagaggtgacggcgaacgtcagccttctgaaagatgaagcagatggaggctataagctcagtgtcacactgcaagtaaaaggaaccggcgttgaacagagggagctcgaaaaactcgtccatcaagctcataccgtttgcccgtattcaaaagcaatttccggaaatgttgatgtcaaccttgaagtgatttcttaaaaaagaggcgccttcagcgtgtcgccaaaccctcgcattcgttgtcaggcctgcgcttcggtgctcacgaacaggagaaggatcggcggctaatgccccaggcgtcctgcctgaacgccgccgtcatcacatcctgtgaaagtcagctccgatgctcggccttcctagactgcaagggttgcgggtcacgctgaaaggacgacaaaaacccaaaactgttttttgttttgggtttttgtcaacaatctgaaggcgcctttttgctgtctttacagcacatctgtttttttcgtcaatgaagcaagaagggattcaagcgtttgcttcaagtttttcagttcgccagccgacagatcggtctgggcgatcatgtgctgcggaatgctgcttgctttttcttggagtgcctggccgcctgctgtcagtctgacaattacagaccgttcatcttcaggtgaccgctctcttgttaaaaggccgtgctgctccattctcttcagcatcggcgtcagtgtgccggaatcgagataaaggagcttgcccattgttttgacgcttaattccccgtgttcccataataaaaggagcgcgaggtactgcggatacgtaatattgagttcatcaagcagaggcttgtaaagcttcgtcatttcacgcgagcttgcataaaggagaaagcaaagctgtctgtcaagcctcatatgttcaaattcgtttgccatcgtttcaccaactcttttttatgttcctttttattgtataagattttgcgttcttttcccattgatcggctgaaaacccgaaaaaacaaaaacggatgtttaaaaaactcattttgtgaaatataaagagtagaggaaaaaacgtaaggaggaatcaggatgactgcattgtttacagcaaaagtcacggcaaaaggcggaagatccggacatgtcaaatcagatgacggggttttggaccataacattgttatgccaaatgaaaaaaaagaaggcgaatcagggacaaatcctgaacagctctttgcggcgggatacgcggcgtgcttcggcggcgcattggaacatgtcgcaaaacaaaaaggcattgacatcgattctgaggtcgaaggccatgtgagcttgctgaaggatgagagtgacggcggttttaaaatcggcgtcaagctgatcgtcacagcaggcggggtagaaaaagaaaaagcgaaagagctggtcgaagccgctcatgacttttgcccttattcaaaagcgacgagaggaaatatcgacgtcaatcttgaagtaaaataaataaacgggaaagatgaaaacgagaaagcaaacaaagcttgtttgctttcttttttagaaaggagcagcatatggcatatcttaaaaaagcgcttgtgttctccgtgctttctctcgctattgtccttgcaggatgcggaaccggagcggcggagaagaacaacggcaatcaatccccggctgatacggccaagcagaaagcacctgatttgaaaacatattcccttgacaaaaatatccggtctgaagaagattttgatttgataggcaagtatgttcatgctgaagatgaccaaatcacgctcgaaataaaggataaggaactgattgttccgaaaagcagccgctttcacagcgaagaagaccatgatgacttaatcgggaagcttgtgaaggtagaggtggatggaaaaacgcaagaagcggaagaagccgagcttatgccgcagtcaaaagccgaccaaaatggcgtatatgaggaggagaaagacggcagccgaaaaatcatcgccacgtttgtcagcgagtcggagcaaaacattacaatcaaaacaaaagcaggggaaaaaacttatcagaaaacagccgattttgagagggatgtcgccgaagcacctgaaaaactgaaagggaaaattgtcaggcttgaaattgaaaaggatggaaaagcagaaagccttgatttggaatcggaagatcaaaagcttgaatggtatgagccgtctgcttcaaaataaaaaaagcttcctgatgaaggaagctttttttaatattccactttttgatcggtcttttcccatgtgagaaaaggttcaagctttgcttgaaggtccattttataaaaaggaattttccgttcgcttttcgttttggtgatttcttcataaataaaagagtcgtcaaaaccggccgatgcggcatccgaatgctgagcggcgaagtaaacttccttcggtctcgcccagtagatggctcccaggcacatggggcacggttcacagcttgtataaagaatgcagtcgttcagctgataatcgccaagtgcttcacaggcgagccgaatagccgttacttccgcgtgcgcggttggatcattgcttgttgtgacattgttttttccctcggcgataatttggccgtctttgactatcacagcgccaaaaggtccgcctgtgccgcttttcacgctctccaccgcaaggtcgatggcgcgctgcaaaaatgcttcatgattcatttctgtatcctccttggttgtcttgccttcttattatagctgatggacccggcaaaataaacacatgtcagaatattcagcatatttgatttcaaaccgcacatcgcatacaatgaatgctagaataatgaacgggggatgatgttttgcttacattgtatattgcaagacacggtcagacggaatggaatattgaaaaaagaatgcaaggctgggaagactccaatttaacggctttgggactggcaaacgcaaatgccctcggcgaacggctgaaagatgttcaattccaagccgcatattccagtccaagcggccgggccgttgattctgcgcgggctatgctgcagaaccgcagcattccctttataacagacgacagattaaaagaaatctcgatcggccgctgggaagggaaaacgtatgatgagatcaaacaaagtgatcctgacttgctggaagcgtattttaatacgcctgaaacatatatgcccgatgaaagcgagagcttttacgattttgaaaggcgggtcagtcaggcgtatcaattcattctccgccgccatcgggaaggcaatgtcctcattgtcagccattccgtgtttatattgatgctcttgaatcttataaaaaagaggccggtcggtgaactatggaactcaagctatgttcatgacacagctcttgcggttgtaacggtttccgaggatggaagcgccgcgattgaaagagaaggagacggtgaacatagagtagaagcaaagaatgccacctggtaggcatgccaaaaagcctgatgttggaatcaggctccgaggctcctagccggaatatattttggcactgaagctgtgaagcgtgtcggcggtaatcgttttgttttttgaaagacaaacggttttgacatctgccgcatctgcttccgctttttttccgaaaagtaagactgtaagagaaagcgggccttttgcgatttgctgatatgccagaatgcaaaggttgtcggcgattgtgcggctgatcatgcggcgcgccgaccacagctgctgctgtccctcttcatcaaactgaatatatgctgcggctcgtttttttgtaatgagtcctgacagaccgttttgtttgatctgcttcatgagagcgagcggttcagacagcggcggtgcggtcagtttatagctgccaggggaacatttggctgcagccaaagaagacatgatcggcaggtagccggccaaatgcccgccgctgtgaaagagcttctccgcaagcatctgatcggtctttttcatgcggatttctgtaaagtgcaggagatgctgcaaatcatcgagcgtgtgtaaaaatcctttgagttcatgttccatttcggattgcgcctgatcgatgccgcatgttcttgctgttttcacgctggagaaaagaacatgaaaatgacggttcaaaaggcgtattaaatcgctgattcgctggtgggaatagcgaaattggcgggcgagggcgtgcagatcattgatgttcagccggatcgtcatatcagctcctcggctttcagctgaagccgttcaatttcttcgtccgcctgctctttaatggtcctcagcttgtcatacacgcgcgattccgcccggtcgagatcgtccaaaagcgcgtcatacatttcgcgcgcctgtccgcgccatccgttgatatacgtttggtgtgcttttaaaatagaagaactttcctgcctcagctcatcaatggcggcattcacatcttttacgtatagctgaagagagtgaatgtcttcctgatatatttttcgcttgatttttcgttctaacgctattccatcgtcaatcactacatattttccttcccttccatcatctactacaaatatgttaaaagaaaaggatacggaaggaaatcgtacgaatgaatcaaaagtcttaatgttttttgggcggacataccttgtataacggttcttttggcctaaaaagggctggagccatgaaaagagccgcccgtgtgaacaggcggcgtttgtagtggattttttgtgaaattaaacagtctgagccagtttgcctcttgcttgtttggctgcttcaaccatattcttaagcgctgcgatcgtttcctctggctgtctcgtttttaaaccgcagtcagggtttacccagaagcgatcagccgggcagactttcagcgcgtcttctatgatcgtgagcatttcatcgctggaagggacgcgagggctgtgaatatcatatacgccaagaccaagccctttcaggtaagggtgctgttccagataatcaagaaatccgccgtggcttctgctgtgctcgatcgtaatgacgtctgcgtcaagatcttcgatcgcgtctacgatatcttcaaagttgctgtagcacatatgcgtatggatttgcgtcgtatcttccacagatgaagtggacagtctgaacgcttctgcagcccatttgagatactcgtcccaatcccgttctttaagcggcaggccttctctcaaggcaggttcatcgacctgaatgatttgaattcctgctttttcaagcgcttcaacctctttgcggagggcgcaggcgatttggaaggcgatctcttttctcggcaggtcatagcgggcaaaggaccagtttaaaatggtaacaggccctgtcagcatgcccttgactttcttcgaggtcaaggattgggcgtaaaccgtttcttttaccgtcatcggctctttaaactcgacatctccgtagatgaccggcggccggacgcagcgggaaccgtatgactgaacccaggcgtatttagtaaaggcgaatcctccgagcttttcgccgaaatactcaaccatgtctgtccgttcgaattctccgtgaacgagaacgtcaagtccgagatcttcctgaatatcaatccatttctttgtttcttcctgaataaatgcttcatactgctcgtcggaccattcttttttccgccatttttgccgcgcgctccgcacatccgccgtctgcgggaagctgccgatcgttgttgtcggcaataggggaagtccgagagagtcattttgaatccgcagcctttcttcaaaagctgtcgggcgtttaaagtcttcctcagtcagcttgcctctttcttcggcaaaggccgaatttgtcgctgcaccgtactgtttgagatcttgaagatgtccgtgcgcttcatcgatttccgcttggatggccgcttttccggaaacaagtccgttcttcagcagtgtaagctccagaagtttctcttttgcgaaagataaaccgttcaagagatcgtcggcaagatgttcgcccgggtgttttgcgacagggacatgaagcaggctgtttgaaggctgaatccagacttcgtcaacacccgctctctggatcagttcaagcgtcaggtcgaggcgctcttcgagattggctttccaaatgttgcgtccgtctaaaatgccggcggcaaggactttgtctttaggaaaaccgtgcgctttcaggtgttcgaagtttttccctttatcatgaacaaaatcaagaccaattcctgcgacaggaaacgatatcagctcttcataagcatcaaccgagtcaaagtaggtttgcagaaggatgttcagttcagagacttcttctgtaatcgtctgatagatttctttgacagcagccgcttcttcaggtgaagccgtcacaagagcaggctcgtcaatttgcacccatttgacgccttcctgctcaagctctttcaaaacctggatgtaaagaggtgtcatttggttataaatatctttaatatcctgttgttcatagccttttgcaagggctacgaaagtgtaaaggccgagtatgacgggcttcgtttctgttcccaatgctgcttttgctctttggtaatcttgaagcggtttgtttctcgtcacgcggtattgtgcacctttttcatattcaggcacaatataatggtagtttgtattaaaccattttgtcatttcactcgatacagcatctttcgtgcctctcgccattgcgaaataagtatctaacggatcgtttatatccttgaatcgatctggaatccagttgaacatcaccgccgtgtcaagaacatggtcgtacattgtaaagtcggaaaccggtatgatatcgatttgctgatcaagctgagtctggagcgctgctaaaaattgttcatccatttctttcaaaaaggtctcgcggtccgtgtttcctttccaataagcctcaagcgattttttccattctctgttcaagccgattcttggaaagcccaagctgctcgtttttacattagtcatgtctggtctcctccttttagtgttcaataaaaaaagacactcacacttcggacaatgagaaggtgaatgcctgaaaacagcatgttgcgaacgagaaataaacgtagcgattgttacgtcaactcgaacacctcctatcgaccgtaggtttatggtgcgtcagaacaggcaggtctcctggctcatgaatcgacggttatttcccccttcccatatagaaacagtgggttttatgaaataacctcctcattcacagtggcgggaccgcgttggattttcaccaaacttcccttttaaaatctaacctcgttagattaccatgttcccggcgatgaaattgtttagtagattatataccgccgcgatcttttagtcaaaataatttttgaattcttgcaattaaaaagattcagctttatacatggccatgaaaaaggccgccgacattgtcggcagcctcctttagactgttaaagggaaagaagttttgcttcgccggctttttccgccagtacctccggcgctgacaaatataagaatccgttgccgatcagcgcttttgagtaatcaagaggaagggtgcggcggattaactgagcatacagttcgggttctgtcagtttccgtttaaacgcctcttcttcagctgacttgatgagagcgagcgcgccgctgacgtgcggtgtagccatcgatgttcccgtcagctttccgtattgatggtcgggcaatgtagagaggatttcttctccaggtgcaacaaggtcaatttctttgttcgcatttgaaaattcggaagactcacgcgtcaatgacacggatccgacggcgatgacttcgttgtatgcagcagggtatgagtactcctctgtacggtcattgccgtcgccttcgtttcctgcggcgcagacgacgagcactccgctcttcacggcgtttgtcaccgcttccttcaactccggaacgtcggcaggaccgccgagcgacattgaaataatgtcggctttttgctcaacggcgtagttgatcccgttgatgatccattcataatccccgctgccgtcttcaccgccgagcaccttgacgattaataggttcgcttcgggtgctacgccggaaatgcctccgttttgatcgtttgcggcaatcgtacccgccacatgggtgccatgtccattataatcatgaaactgatcttcttttccgttgtcatcatcagtgaagtttctgcctccgatgattcggtccgccaaatctggatgggttgcgtcacagcctgtatcaagcactgcgacagtgatatcttttcctttaaaaccttgtgaccacagctccggtgccttaatcgcatcgattccttccggcagttcattcacgtccatcagctttgtgtcagtgacataaggaattaatcgcatttgcatttcaaagccctccctgttatatgctgctttagatgggttacaaggtgcgtgattctattgtaaaacattcactttgttaaaaaaaggttcatttgtatgaattttatgaaaagttaaaaaatatagataatagaggatataagtcgaataattgcgaacaatgctggaattgtaagcgaaaagacctgtgaaatcggtggaagggcgagagagtcactagatatatgagatttcgcttcaacatattatcccggcaaaaggatatcctattaaaaaaaggagtggatacagggtgaaagaacaagaagacgaaaaaagagacgaattatcaatcgagcaggcggagtttgtgccgcatccaaaatatgaaggagaatacgcgcttttactgcacgaaaactatcacctgctgtcaaaggacgaccttgagcaggaaagcgaaaaataagaacggagctcggcacctgggcgaaagagctggtttaattttgacgaaaacgggaatcaacacataatagagagcatgaaagttgcttttcttattgacagttatcctttttttctgtaatctcattgtgtccggtaaatacagctcttcgttaggtgaggctcctgtatggagatacgctgctgcccaaaaatgtccaaagacgccaatgggtcaacagaaatcatcgatctaaggtgatttttaatgcagctggcatgctgcctatgccatacagtgctaaagctctacgatggaaggcgttagggttttattttgtatggcttttaacaccttcatttcgatgaataggtgtttttttattttttgaggaaaatgaactttccgtattaatcaaggaggtggtagtatggattctccccattcgaggcggtttaaacatacgagaaatattttgcagcatcacacattgattgatgaggagatccttatacttcaccccttttgctatggtgatataaggatctcctgaaaagggagggacagattgccatggtaaaaaacatgacatatgatgaactgattttacgcattattattttgctgagagacggaaaacgaaaagagttccaaagcgttttagaagaactgcagccttatgatatggcgattctgtttaaggaaatgcccgaaaagcaccgcggccggtatctgtcttttttaacggtagaagacattaccgatctcatgggcgaacttgacagagaagagcagctagtcgttctgaacaaggtcggcaaagaaaaggcgatccatgtgatgaataaaatggacaacgacgaccttgccgcgctcttcgaggaaatggaccctgagctgaaagaccagcttctatccagcatggaagcggaagaatccgaagcggtccgcgttttgatgaactacccgcctgaaacagcgggaagaattatgacaaaccgctatgtctggattccgcagcattacacggtaaaagaagcggtcgtcaagctgaaaagctttgcggaaatcgcggagtccatcaactatttatacgtcatcaacgaacaaaaacagcttgtcggggttatctcataccgtgatctcattttggcagaacccgatgagaaggttcaggaattaatgtttacaagggtcatatcggcggacgctcttcaagatcaggaagaagtcgcaaggctcatcgagcggtacgactttctggcgattcccgttgtagaaaaaaatcatgagcttgtcgggatcgtaacggttgatgacattatcgacatcgtcatccaggaagcgaatgaagactatgaaaaattcgcagcatcaggtaaggcgatcacgtttgatacaaaatcgtatgtcgccgcataccgccgtctgccgtggctgatcttgcttttgttcatcggtttgatctctggcagcatcatgagctattttgaagacacgctgcagcaggttgtcgcattggccttttttatgccgatgatcgcgggaatgacgggtaacactggaacacagtccctcgctgtcgtcatcagagggctgtcaaaagaagagctcaataaaaaaacgattttccgcttgattttccgggagcttagagccgggattattattggcgtcgtgtgtgcgatcgtgattacgggaatcgcgatagtatggcaggggaatctgctgctcggatttgtggtagggacttcgctttttgccactctgatcatcggaacgatggcgggaacgatcgtcccgatcatccttcacaagtgcaatgtcgaccctgcgattgcatcgggtccgctgattacaacattaaatgacattttgtcgctgttgatctacttcggtattgcaactgcattcattcattcgctgtaagcagaaaagccctccttatccggagggttttttgcttgccagaattcgtaaaagcctttatattttaggcagagatcaggggggggattggtatgagaaggattgcagctgtgctgatttgtttagccgttgcattgattgttgccggctgtcagaatgaagatgaaggaaaagacaggcggctcgtcgcagttgaggatatgcttgaggcgatattggacgatgatttatcaaagatgaagcgcttgtacgtggagggcgcaaacccttctccggaaacaatcttgaaagacaagcagaaatggggaatttccgggcttcatgctgatgattttcaaatttctgaagcgagcatccatgtgtttcatgccgcttacaagatggaaaataccggtcagcccggaacgattgcgtttcggatacgcaatgatcccgataaaggcgttatgattgatttcattggatacataaaggaagcgaaaaagcaggaaaacaggtgacgaatcatccggagggaatgattcgtttttttaacggtttttgtatttaaaatgagcgttaagctggccttcgagcattttctttctgagctgctggtcgttttttagcctttgttcttttttgcgcatatctttgaggatttctgcggtctgaacaccgtcttcccgcttgtttgcgatttccatcagccgttcgacgtcagcaaaggaatatttgcgcgtgcctcttgtagagcgctgcggatagatcagcttgcgttcttcgtaatagcggatctgcctgaccgacagacccgtcagctcgctgacaatgccaattgaaatcacttttttatctttataagaaagatcttcgactgtcattttcccacccctaagatgactttttttgtattatataagaaaacgcgcgaaaaaacctgacatctgtcagaaaatctaacattgttgaaaaaatttttaaaaaatcacggaagaaaagtttacaggaaccatgcaaggggtaaaagtgttttgtatgctgtaggtacagacttttgaggggggaatcgttggatgaaggaacacaaagcagtcttactcgccaaagaaatcgttgccttagacaataagagagacgaattgctcgagacattgatgaaccttgccggcaaggatgcgtttccgctgctgagggcggtgcagaacggcttttatcaaaagtcctcttaaattccggaaggggagtaaaagcgaactttacacggccttaaagcttggttaataaataaggtctattcttatagtatacaatacgcgaaaatgaaaggagaagatcatgagcagattgttaaaaaacgctttggaaaaggaaagaaaccattacttgaaaaaactgatctcactcggtgagcataatcgggaagttttgcagaggatgacgattacggagctcagaaatgaatatttttattttttccggaaaaataaagcccgtgttcaaaatcggccattttgaaaaaacgggcttctttttaatatctaaaaaaaaataagcaggagttttctttcggataacgaaaatatatacatatagaatatgggaaaagcatgaccctttctttttctacatttgtaagggttttcatttcccgggttcattttaagaaaatagtataagaggtagatgatatgagactttcgtttaatgaggaagaagttcaccgtgctatgtcgctgtacaaggtttttgccagggcttttaaaagcgtttcagaacatagtattcgggacagcaaggaacacggctttaatcctacagaatttgctgtattggagcttttgtatacgaggggagcccaaaagctgcagcaaatcggctcgaggctgctccttgtaagcgggaacgtaacctatgtgatcgacaaactggaaaaaaacggtttcatcaaacgagagcaggacccgaaagataaacggtctgtctatgcgaatttgacggagaagggaaaggcatatctcgatgagatttatccgatccactccctgagaattgcgagggctttttcaggcttgacaaaggaggaacaggagcagctgatggtccttctgaaaaaagccggaatccacagccagcacctattgtttcgctgaaaaagtcagttttccgaacggttgttttcttttaagtgatcgagaatagctttgatctgtttgtcctggggctgtctgaagaagctttcgaaagggcatccgagttcctttgtgcgtttgacgacagcctccatcgtaaaatttaagggtgacaagtctgaatggacttcatcccaaaacagcggtgcggccactgtgccaagctcattgcctcttgtggaatacgggcagatgatcgtttttcccggggcatgctgcacatagtcaatatagagctttccgcccctgtttttgatcaggcgttcggttgtgaacagatcgggaaaaagcgagacgcaataagaagccgcaaagcttgtgaaaaggcgggtttcttcataagtaaaggcgttttttgaaatcggaatatagatttgtatccctttatttcccgacagctttggaaaagataagaggccgagctgatcaaataaacggtgcagctctttcgcggctctgacggccagcggaaactccgactttgaaggcggatcaagatcgaaaacgatttcggtcggatgggccgtatccaccgtttgaaaagggatatggaactccaacgcaagctgattggcaagccacagcagaaccgaataatcgctgcagatgatatgctcgtgctcgtcatcccgaatggacgtgataaattcgggtgcgtagtcgggcttgtttttttgaaaaaaagactctccgccggaaccgtgcggataacggataacggtaagcgcccgattgtcgagaaacggaagcagaaaatcgccgatttcattaaggtatccgatgtaatccgcttttgttttatcgcttttaggaaagatgactttatcaaggcttgtcagctgcaaatcgggatggacgtttcttgaatgaagcagcaggcggttgtaagtgcaattttcccatgccatgtcaaattcaaatgaaacaaacgacacctcgcgcaatgtcccgtaatgaatcgttaagtaatggaccgtcatgcaaatcgacggatcaatggtatattcaccgggttttgtttcggttccgtattgcttgacgatcgaaagaatggcgtttctttcctgttctccgagtccgtgggaaaccgaaccgacttccttgatttgaccgcggtcatagacggcgattgtcaaataacggtttgccatgttgtagcctgtcataaatacagcagcttttttgtagtttttgagtttgagccattcggccgtttttttattttcagcccagcggctgtcttttttcttcgcgacaattccctcgccgtcaaaccttttaacagccttccaaaggtcgtggaaatcagaagtgtcagggatgtattgaattcgagcgtgagccatcggatcgggagccatcggcaggccgagctctttcatcaggtcgaaaagcatgcgttttcgttcggtataggggagcgaggttaaactttctccgttaaaaaccagtaaatcaaaagccaagtactggcacggtttctttgcggctgcttgtgcaatcaactcggcctttttgctcaaaccccttttttggacatattcaaatcgggaacgaaaacggtttgtcaacgacacaatttccccgtcaatcgtgatcggcaagtgttctttgagagtttcgatcatgctttttgcaaattccgaaatttccggaaatgtgttttcgagcggctgtgagtttctgctgatgagcgaaacttcgccggtcgcagcaatctttaaaagaccccgatacccgtcatatttgacttcataccgccaattgccgcctgagggagctgatgtagtcaatacaggctgcatcgtaattcccattttttattttgcctctgaagcttttttgcgcgacgtttttttctttttctcagctgttccttttgctgcaggcgctttcgccgcttcccggtcaggcccttttgtccgttcgatgctggcttggagagcgctcacgagatcgattacatcctcgcgcggagcggcggccccggcatttggcgtgacaccttcattatggtcgattttctctttgattttatccatcagcgcgattctgtacgtatcttcatattgttcaggcgcaaatgtcgttgtcagctcgtctattaatgaaatcgcggtttgcagctctttttcgttgactgcggtttcttccggaacaccgggtacgtgggctgcgtttcggacctcatcagggtagtggatggactccattaaaatgcagttttcgtagacgcgaagaatggcgagctgtttttttgagcggatggtcatatgggcgatcccgatcttttctgtttttctgagcgcttcgcgcaaaagtgagtacgcttttacaccgttatctcccggtccgacgaaatatgaacggttgaaatagatgggatcgatttcctttagctgcacaaaatcaacaatttcgacggccttgtcttcctgctcttctttgagctgcttcagctcatcgtccgataagacgacgtatttgcctttaacatattcgtagcccttgacgatgtcgtcgggcgcgatttcctgatggcagtttgtgcactttttttcatactgaatcggggcgcggcattctttatgaagcgaccttaatttaatatccttatcctctgtcgctgcaaacagtttaatggggatattgacaaggccaaagctgatagagcctttccacatcgtatgcatcggttcggttcaactccttttcttttattgatgcctctctgcagattgtttcatgaatagcaacttatggatgacagaggaaaaaagcatccgggctgaagcccggatgcttgcggcggtacaagtttggagccgttcttcttgaaggaagccttagttcagctcgatttccttctggaaagacggtctgttctttctggcgagggaagacgagaagtaccgatatctgcttacgctcttgtactttgcggcgtacatagccatgtcggcttttctcatcagctcatcgccgtctgttccatcgtccggagaaacggcgattccgatgctgacggatgttttgaggcgatgctctttaatgcgaaaaggcgtttcaaactgactgatcaattgcctggtcagctgatcgatcccttgtaaaggagcgacaatgataaattcatcgccgcccagccgggcgataaagccttcattgggcacacagtgcgccaaacgctgtgcagcagccaccagcagcaggtccccgacgtcgtggcctagggcgtcattaaacactttgaaacggtttaaatccaaaaacaacacggccgtccctgtctcctgccgctttagaacatttgccagacggtcgactgcataccttctgtttggcaaatccgtcaacgcgtcatagtgggccattctatggattttgcgttctgcttcacgctggtttgtcatatctttgcatatgacataaatgctgtcaagctgctttctgacatacaccggtatcagcgtcacatttaaatcaaagcgcttttcagctatcgcgattgccgtatcgcggttgatggcctgtttttcattttggacttgaaggaaccagccgagcagcctgtcatgatcctcctgccgaaaaacggaagacaggcgctcgggttcaattcccattttttcaagaaggctgtatcccgatgaattggcggaaagcagcttgccttcaagcgaaaaaacatagatcggatcaatgttgtggttgatcaaggactggaaccgctcctcgttatctttgactttttcgatatgaagcagcaggcgtttgtcattgaaggcgccgaaaatcaagaagcattgaagcatcaggctgacaagcacgatcataatgcccagttcaacggtatcgattccttcatagcctgtgtcaacgctgtcagccatgaaaagcgtagctgctgacattcctgtatagtgcatgccggaaatcgctccgcccattaaaagcgcgcttccgattttaatgaacaatatccgaaaagaaccggtttttttggcgaatacaactgacagttttaaggcagcgaaggaggcaaaaatggcgattgcaaaagaggcggcataaagaacgggatgatagacgattgtcatattttccattgcttccatcccgataaaatgcatggaggcaattgcgcatcccattgcaagggacccggccgccagtcttccattcgtcggttttttttcattcaccacataaaatgagatgagcgagcctgcgaaagcggcaacaatcgacaacaagacgaatttcaaatcgtatttcatttcttctgctgtctgaaatgacaccatcccgataaagtgcatagaccagatgccaagccccatcgtgagggaaccggccaaaagccatccgatatttttcctgccttttgtatgtacgacccgttcagataaatcaagggctgtataagctgccaaaactgcagtgaaataggataataggacgagccatccattatattcaccaagaacttctgtcacttttttctccgcctttttgtacttatgatgaaaagtctaaataactatactgtattgtgaaaggctagactgccgtactcttaaccgttgacataaaaaagcggcaatagcgctaattccggtataattcgtgaattatactatatataatgaaattcgccaataaaaaatgatatcctcctgttctttttaaggaggacttcccattttgctcttcaattttctcgaattgtgttaaaatcatttttgtacgttctttagaacttgaaattatcaatcgtcaaaggttgtggtcgatatcgaagagtttattttatcaatggctgaggcatttaaaagcctctcgtatttaggcattttcctggcgctgtgcatcgaattcgtgccggctgagatcgttctgccgcttgccggatactgggtgtatcaaggagatatgtcgatgttcggggtcgttgcagcaggttcactgggaggtgtcgcaggccctctgacgctttactggctcgggaggtacggggggcggccgtttttggaacgctacggcaaatacttctttatcaagcctgaagcgcttgaaaaatcggacaggttttttgaaaagcacggcgggtttgtcgcattcagcggccgttttatacctggaatcagaacgctgatttccattccgtgcggactcgcgaaaatgaatgtgtgggtattttgtatttatacattcctcgcgatcacgccgattacgttcgtctatgtctatttaggcttttacctcggcgaaaactggagcaaggtcggcagcctattggacggataccttcttccggtcggcatcgggttcatcgttttgttcgttctttacctttggttgaagggcaggcggaacaaaatcaaatcgcaaagcgtttcagcctttataaataaaaataaggattgacagccgtgcgcatatgaggttaatattatcttataattcaatattttcttttatcccaaaggggagtagcgtccggatgtttaaccggaaacaaagtcgtcagttcatggatcttcatccatcggctttgttggcatgttttaaataatgataaccatgtctagcaagacctttgcctaatgttggcagaggtcttttttgttttctgaaaataccctgccgcattagcgggaataagagaaagagacaatcacttaggaggaattacaaaatggatgcagcattattacttgaatatggttgggttcttctcatcctagtcgggctggaaggcattttggccgcggacaatgccctcgtcatggcggtcatggttaaacacttgcctgaaaaagacagaaaaaaagcgctcttctacgggttggccggcgcgtttgtgatgaggttcggcgctttgtttgcgatctctttccttgtcaatgtctggcagttgcaggcgatcggcgccgtttatctgctttacatttccgtccatcatattttgaaaacccacgttttcaaaaaggacgaaaaagtgaaggagacgaagcaaagcggtttttggccgacggttatcaaagttgaactggcagacatcgcttttgccgtcgactcgattttagctgcggttgcgctggctgtcacacttccggcgacaaacctgccgcaaatcggcgggcttgacggcggacagttcatggtaattttagccggcgggatcatcggattgattattatgcgctttgctgcaagtcaatttgtgaacttgttaaagaaacgtccgagcctggaaacggctgcttttctgattgtcggctgggttggtgtgaaactgacgctctatacgctcgcacacccgcaaatcaatatcgtctctgaacattttattcattcaggtacttggaagttcatcttctgggcggtgctgatcgccattgcgctcgggggatggtttatgacaaatccgaacaaacacgagaataaagctgctgaggagtaaacagcttttcccagactgccggtctttcaccggcggtctttttttgcccgcacgaggaagagccggggaagatggccctagatcaatcgaaataagatttcattttattaacagccatgttacaaaaacggcgggaaaacccccttaatcgtcaaacagatcacgaattgttctaggagatcaaacaaatgactgtcacaattgaaaaattagaaatgaataccgcgttttctcctttgcgaatccctatcaaattagctatcattaatgagtagtatagggaggaactgaggtgaaaccagtgcttagccttttgtttaagacaggaaaaaggaaacaatcattagaagagtctgtaataagcatacaaaaaggaaatcagcagttgcaaaacgagcttatcgatcaatataagccttttgtggctaaaacggtttcatccgtgtgcaaacgatatatagatgaaaaagatgatgaattcagcatcggcttgattgcattcaatgaagccattgaaaaatattcttcagataaaggaaattctctgcttgcatttgcagagctgatcattaagcgcaaagtcattgattatatcagaaaagaagcgagaaatgcccagaacatcaatatggacatgcaagaaggagaagaacaggaatcctcccaaagcatgattgaagcggagctttccattcatgaattcaaccgcatgctcgaacaggagcaaaggcgggaggagattctccattttaaagaaaggcttaaaagttttggcctgtctttttccgatttgctggagcattccccgaaacatacggatgcaaggcaaaacgccatcaaagtggcatatacgcttgtcgaacatgaagaattaaaaaagatcttgtttgaaaagaagcagcttcccgtcaaacagcttgaaaagcttgtggctgtcagcagaaaaaccgtagagagaaaccgcaaatatatcatcgctatggcgatcattataacgggcgattatgtttaccttaaagattatctaaaaggggtgctcaattcatgagaagaggaattattgtagaaaaaaataaaaaattcgtcacattgctaacccctgacggacaatttttaaaagcaaagagcacagaggaagattatgaaatcggtcaggaaattgcttttcccgcggagacgagaatgtcgagaaggcgtgcgggcttttttgatctgctttcgctccgtccgctgaaagccggcgttttttcaatcgccgcgatcatgctgctcgctttcatgatcatccctgatgttttaaacaataaagcatacgcctacatgacgatcgatatcaacccaagctttgaattgacgctcaacaaaaactgtgaagttatcgatttggtgccgctgaacgaggatgggaaggccttaatggatagtataaaaaattgggaaaagtctgactttaaagaagtgatcagtgaaattgtcgaagacagcgataagagcggttatgtcaccgaatcaaaagaagtgcttatcgccacagtatacgaaaacaatgaagatgacacgtataaggcgacggtaaaaagcgaaatcgatgatgtagcgaaaaaatacgagcagcagaattataagatggaagcggtggaatcagaccttgatacgcgtgcaaaagcccaaaaagaaggcatctcaacaggccgttatatccgttcccacaaagatgaattagaagacaaaaacaaagatgatgacaatgaaaataaaaaagatgatcaaaatcaggaagaaaacacaggagaaaaggagaaagctgtgaaagaagaagatcagccggaacagcatacggatgataaagaagcagatacggaagatcatccggacggcgaaaaaccttcagatgaagatcagtctcaacctgatcaagaaatggaaaaagaaaaggagtcaaattcccctaataccaaaaaccctcaggaacataaccataatgacaaagacggtcagcagacggaggaaggaacgccaaaaagcggttccggttcaaatcaagagagctctaaatcacctccttaccaaaaggagaaaaagccttctgaccaaacgaataaacaagaatatccgccgagcgggcccggcgaataatccatagggtatttatttgtcattatgcccattcaattgagcttgtgcctgctgtacaagtcgttttgtcatttccccgcctacagatccgtttgagcgagcgaccgagtccgagccgagctggacgccgaactcttgggcgatttcgtatttgaactggtctaaaacctgctctgccccgggaacgaggagcttattcgttcttgccatgcattctcaactcctttttcaattggtactgcttgtttagtttgatttggactgaggctttttatgctggcaattgttgaagggcaaaaaaacgcctggcaattggcaagccaggcgcgccggtcggcgattatttcatttcatattttaagaagacgctgtcaatcatggaatgtgcggtcgcctgaatgtgcgaagcgatgacggacagcacagtgactgcggtgatgtctctcgctttgttccattcgggatcggccagatctttataaaaatcgcggagctgtccagtctgctcaatgacgattttttcaagcgccgatttattgagcgtatagtctttgatctggtacacatgatcaaggacccgcgcatacccttcataaaagcgcagcggactcactacatcatcggagcggtctgtaatcgtattaaaaatcgttgttaagatcggacggatcgtttcgaagtcataaaccgattttaagtctcgtacaatgagaaggatgacggcttggtcgatggaatattttttgccgagttccggatgccccatcaaatcttttatatcgcgtttgatccagttttggatggctgtcgattttaaggatgtcagttcgcacaaatttccaagttcaacaatttcatttgtggaaagtccctgttccgttttttgttttttccgttcgtaccgggcaatgaattcggggatgtccaaattgtcttccggctcatcgggcgccaaatcggccgatctcaaaagaatcgctagcggactgacatccagctgcccttttaaagcgtacatcagtttggccatttccaggcgagtcagtttaaaaggtttcatcattccacctcattatgtattaaaatgaaatagcaaacaatataaacattatcttacgtcttatcacttgcattttcaattctatgccgtataattttattatacgagttcatttgatcttattataacatggaggtaatcatgggaaaaagaatctttctctttcttttatcgaacatcttagtcattacgacgatcggtatcgtgctttcgattatcggttcgctgacaggggtaggcacgtatttcacggctaacggcggcatcgatattgttgcgcttctcgtatttagtgcagttgtcggttttgtcggctcctttatgtcgctcttgatgtcaagatggatggcgaaaatggcgatgggcgttcaggtgctgaatcctgataagcaaacgctcagctatgaagaacagcagctcgttgaccgggtatataagctgtcccgcgctgccggactgacaaagatgcctgaagtcggcatctacaattcacgcgaagtgaatgcctttgcgaccgggccgtctaaaaaccgctcgcttgtcgctgtatcgacgggccttcttcaggaaatggatgacgacgcagtggaaggcgtacttgcccacgaagtggcgcatattgcaaacggcgatatggtgacgatgacgctccttcaaggaatcgtcaatacgttcgttgttttcttcgcaaggattgcggcatgggctgtttcacgcgttgtccgtgaagagctggcgccgatcgttcactttatcgcggtcatcgtattccaaattgtgttctctattctcggaagccttgtcgtgtttgcgtactcccgccaccgcgaatatcatgcggatagaggaggagcagaccttgcaggcaaggataagatgattcacgcgctccgctcgcttgagcagtacacttcaagagtcaaagaagaacaggcatctgttgcaactttaaaaatcaacgggaaaaagcatacatcgcttttctcaacacaccctgatttaagcgacagaatccgccgtctggaagcaaaataataaagatgcaaaccccctttttcaagggggtttgctttttaaatttaaaaatcgaaaagcggctgtacataatagcatgtttcctttaaaatggaacacgttatacacaagaagcaacttttgaatattgaaaagaaggaacgattatgaaggttttattgagaaaactactgcgcgtgctgtctcctgtacagctgatcgcgctctattattttttagcggtgacagtttcggttgttttattgagtctgcccgttgcacacaaaaataatgttgaatggtcttttatcgacgccctttttaccgcggtgagcgcagtgagtgtaaccggtttgacggttgttgatacagccgatacattcagcacggccggaatttggattttggcgtttgttctgcaatttggcgggatcggcgtgatggctttgggtacattcgtctggctgattttcggcaagcggatcggtttgaaagagcgccgtctgattatgaccgatcaaaatcaatccaacctatcgggcctcgtcaagctgatgaagcacgtgctcggcttaatcctgctgatcgagctgtttggcgggctgattctcggcacttatttcttaaagtactttgagacacctggagaagcctttatgcacggattttttacaagcatcagtgcaacgaccaacggaggtttcgacattacaggcaactcgctgattccgtttcagcatgattatttcgttcagtttatcgtgatgatgctgatcattcttggagcgatcggttttccggtcctcatcgaggtaaaggattttctgctcagcaaagagcgtaaattctctttcagcctgtttactaaattgacatcagtaacttttttccttttagtaattggaggtgcgatcggcatatttgccatggaagcgcgctttgctttttcagggaaatcgtggcacgaggtatttttcttttctctgtttcagtcgacgacgaccaggagcggcggactcgcgacgatcgatatcagccaattcacgcatacgaccattttgtttatgtgtatgcttatgtttatcggcgcttcgccaagctctgtcggagggggcatccggacaacgacctttgccttaaacctgttggccctgttccacttcgcgaggggaaataaatcggtgaaggttttcaaaagggaactgcaccaagcggacttgatgaaatcattgattgtaacgctgatggcggttattcttgttttcgtctcgacactcattttgacagtgacagaaaagcattctttgcttgaactgctgtttgaagtgtgttcggccttcggtacgacgggcttgtcgatgggcatcaccccagatttgagcacgattggcaaaagcgtcatcatccttctgatgttcattggccgaatcggcattgtcacgctgctttatttattcggcagaaaagaaatcgaagcgaattaccattacccgaaggaaaggatcattatcggataagaaagacagtttagtcaaactgtctttttttatgatcataaagtcggtcgctgtatttatttgtatgatataatgcttaaatggcggacttgaaaaaaagggggaaacaacgatgaaaaagagagtcatccatttgtttatagccgccggatttctattgctcgccggagcctgttctaacgagccgacagcaaaagaaagcatggaccaatatgtagacaaatggaacgagcaaaaatttgaagaaatgtatgaacagctgtcggctgaagcgcaaaaatcgatttcaaaagacgatttcatcaagcgtaatcaatctatttatgaacagattggagtttccgatttgaaggtttcaaccgtcgacaacgatgaagatgaaaaaaataaagagaaaaatgattcggtgacgataccgtataaagtcagcatgaagacattggccggtccggtttcttttcaaggcaaggcaaagcttgtcaaagaaaaaaaagacggagacacttcatggaaggtcaactggaacccatcctttattttttcacagctgaagaaaggggagaccatccggattaccgccaaggagccaactagaggcatcatttatgacagaaacggaaaggcgctcgctacgaatgcgacagtgcctgaaatcggcgtcgttccggggcagctcggagatgataaagacggtgtcatcaaaaagctcgcgaacatgcttgatatggaaaaagaagacatagaaaaacagctgtccgcaagctgggtgacggacgattcattcgttcccctgaaaaaagtgaagcctggcagcaccgagcttctcaaaaaagcgacctctctccccggggttttgaagcaggatacgcagtcaagatactatccttacggtgaaaaagccgcacatcttaccggttacatacggccgattaccgaagaggaattaaaacagaataaagaaggctacagcgagcattcactgctcggaatcgtcggtctcgaacatatttatgaaaaagagctcagaggagaaatcggctggacgatttcgatccctgaatcaggcgcgacggttgcgtcaaaggatgcaaaagacggaaaagacatccacaccacgatcgacattaagaaacaggaagaactgtacagccagttaaaagatgactccggcgctgccgttgctttagaaccgcagactggagaaacgctggcgcttgtcagcgcgccttcatatgatccgaacgggtttttgttcggctggaaaaaaggagaatgggaaaagctcaacaaagatgcgtctgcgccattcacctctaaatttaataaaacttatgctccgggttcaacgatcaaaccgatcaccgcttcaatcggtctgaaaaatgatgcgatcaaagcggatgaacctaagaagatcgaagggaaggaatggcagaaagattcgtcatggggcggatataaagtcacacgggtttccgatcgactaagcgacgtcaacttggaaaacgcgctgatcacatccgacaacatttatttcgcccagactgcccttgatacaggcaaggatcaatttgtcgaaggcctgaaatcattcggctttgaggaaaagcttgattatgaattcccgacgaagtcttcctccatatcaaacgaaggaatcgactcggatattctccttgccgattcaggatacggacaggggcaaatgctgatgtcgccgatacaccttgcggcaagctatacgcctttcttgaatgacggtaatctgatcaagccgcacctgatcaaaaaggacggcgaagagaaagaaatatggcataaaaacgtactgcccacaggcggagcagaagcgattacaaaagggttaaaaggcgttgtagaagacccgcgcggctcggcttacaagccggttgtcaaagggcttacgatcgcagggaaaacgggaacggccgaactgaaaacgaaaaaagacgaaaaaggcaaagaaaacggctggttcaccgcctatgattacaaaaacaaaaaccttttaatcacgatgatgatcgaggatgtttcagaccgcggcggcagctcatacgtcgttaataaagtgaaaaaagtgtttaaataagcacccttcagggtgcttatttttttgccgaaaactggatgtgtggaatgtgccgaaacggaaaggatatggatgaaacgactaaagaaaggaatgtcattatgaaaagaaaagttgccaggaatgaagcggctcttaacaataaaacgcctgctgaaagcatgcatgatcatcaatacatgacccaatatgacgccgaaaacggagacaggggagccaaccgcaactcgaaacacgggaagcagggagaatcgcaccaatgaaaaaacaccaaaaaagcaaggatatgcaaaaccataaaaaaccgatgaatcccgatgtgcttcaggaggaattttcgaacgaactgggcgatgtcaacgcctttaaatttatcgatgtgatcgagaacaataaaaagaagaacaaaaaggcggacggacagaagcgggataaagataaagaatgaaactgcagagcaaacgagaaaggtccaaatcggaaacgatttggaccttcatttattttaaataagggttatatccgttgtcttttttcaacagccttattaaattcgtcatttttaattcgatgaacggctgggcgaccgttttcacaaatccgcttgataagcagaaggttaaaattgccgtggcgatgaacaatagcgtcagactctgataatcggcaagccattcttccgcgcccgtctttctgaacgacttgatgataaagccgtgcagcaggtagacatagaatgtgcgcgttccccagagggtaaagaaataccgcctttcaggcaccagcgccatgaacgcgaaggttgaggcaaatgttataacgagaagcgccacccggtttaacccgctttttatcccgacatcgccgaattccgaataaggcttggaaccgaacagccaggagtaatcgaagtctgcaaaaaagtagaaaacgaacgttgctgctaaaacggctagagccgcttgctttcctttccagcctttcagcattttaaaatggtctttttgcaaataatagcccgccaaaaagaccggaaagaaaacaaacgtgcgggacaggctgagcgtgttgctgatcatgtcgatatacccgacaagaacggcaatcgcaaagcttgcggcaaacgcccatttcgccggcagttttgtgaacggaaacaacaggagattccaaaaaaacaagctcagcaaaaaccaaagcgaccattgcggttcaaacggatttgcggcagttaagctttgatcatcgataaaggaataaaacagcgtatagattccctggaaaatcaaatagggaacgatcagcttccaggcgatttttttgacatatccgggccgattgaacccttttgcaaaatagcctgatatgagaataaaagcaggcatatgaaacgtgtaaataaatttataaatatgaagcagtgcatcattgtcatgaatataggacctgattatatgtccgaagacgacgagaaaaatcaataggaattttgcgttgtcgaaatagctgtcgcgtgaattcgccataacatcaccctttcgcaaacaatttcaggaggcgccggtgcgggaagattctgaacccggctacattctttccggaatgacgtcttcaaccagtcttgcctcattttaaaattttaaaatagaaagcatgtgttttcctatgcattaagtcttattgttaggccgatgtaattgaacagtaaggaacttttatatcgtcatcttcatgtaaaataggcggaaaggttgtaaaagtttgaaacaaatgaaggaagattttccggtttgtagaataattggaggacaggttttcaagaaggagtgtaataaatggaggaaactcttgatttgaatgaatccttaaatctgcaaaaccagctgaacagactgaagaaagaaaacgccaagctgaaagcggatttgtatcagtatgagctgctgtttaacgggacgctggacgctatttttatattggataaacagatgaacatcattaaggcgaatgatgccgcctgcaagatcctgcaaagccaaaaaaagaatttgctgaaccggtcggcgctcgacttcctgcacgccgttccgccggatgaactaaaccagaacattcaccgcttcttggagcggggatatgcgaaaaaagaagtggccatcaggcttgacaacggatctgtcaaatatatcgaatttaccgcaagcaaaggaatcggtgaggactgcttttttgtcgtcatgagagacatttcgtctaaaaaaatattggagcgggagcgcaccatcaatgaaaagctgtttaaagatttgtttcaccgcgcggttgaaggaatcgtcatctttgataaacaaggctgtttcatcgatgcaaaccattcgttttgccagagcttcgaaattgaaaaatcagagctctcaaaactgaagctgtctcaattcgtatcgcctgaaaacaaggggcggctcgataaaatctggaacgctcttttcagaagagggaaggcaaaaggggagcttcctgtccgcctcagatcaggagaagacaggctgtttgagctgacgataacctcgaatattttaaatggcttttacatgtcgattatgagggatattaccgaaaagcgctcaatggaaaaacagctgtttaagagcgaagaacgctttagggaagtctttgaaaatgcgatggatgccatcattctgatgaataacgacggccgcatcgtcaaagcgaaccagtcggcctgcaaaatcttcgaactgccgatggaccagctgctcaacaagaagatgactgattttatagatcgaaccgatcagcggtatcatgccattcaaaagcagtacgatcaaaaaggggaaatccgggcggaactgctgtttcgtatggcaaacggacaatataaggagcttgagttcacatcaaaacggattatgttcgacagccaggacttaaccattttgagaaatgtcagcgacagaaaacgaatggaacaagaattgcgggaaagcgaattgaagttcagaaaagtattcaacggatcaatggacggaatcgttcttttcaacaaccagtacgatattatcgatgcgaacccccttgccggaaaaattctcagcatccctcttgaacagctgaaaacgtccaatcttcttgatgtcatctccggctatcacatcgaaaacgcggcttctcccgctaaaacgatttcctttgaagaaatggacaatgatatcccattcctgctgagcgaccaaaaacggatacttgaattttcatttaagcgaaacatcattcaaaatatgaatctggcgatgctcagagacgtgacggaacgaaaagagcttgaagagcggctccgcaagtctgataccctccatgtcgtcggagaactcgcagccggaattgctcatgaaatccgcaacccgatgacggcattaaaaggatttatccagctgctgaaaggcagcatccaaaatgaggatcacgcgctttactttaatgtcatcacatcagagctcaaaaggattgaatccattattacggagtttctcatccttgcaaaaccgcaggcgattatgtatgaagaaaaaaacatcgtcaaaatcatgcaggacacaatggatctgctgcatgcgcaggcaaaccttgacaacgtccagatgcatctgaagtgcgaagacggcattccgctgatctactgcgagccgaatcagctgaagcaggtatttatcaacattttgaaaaatgcgatcgaagtaatgcccgacggaggcaatgtatatgtgtcgatcaaaccgaaaggagacgaccatatcattgtctcgcttgctgacgaaggaatcggcatgacagaagacaaattgaagaggctcggcgaacctttttacacgacaaaagaacggggcactggactcgggctgatggtcagttataaaattattgaagaacataaaggaaaaatcgaagttgaaagtgaagaagggagaggcacgacattccacctgactctcccgatcagacagcagcatgaggaggaggcttaatcgcatcgtgggcttttatattgaaatgacctcgccttttggacaagcctacatcgtcgaggaaaataaccatattacacatttgctatttgaaaaagaagaactaaaacagcttcaacaagacggcctggagcttcgcccggccgaaacggaattgttgaaggaggcaaagcgccagctcgaagaatatttccagggggagcggaaaacgttcacccttcctctccgccaggatggaaccccgtttcagaaaaaggtgtgggaggcgctgcagtcgatcccgtacggtgaatcacggagctatttagacatcgcatgcgccgtcgggaatccgaaagcggtgcgcgcaatcggccaagccaataaaagaaatgcgctgccgattttgatcccgtgccaccgtgtcatcggcaaaaatcgttcattgacggggtattccggaaatgaaacggataaaaaagcggtgctgctcgacatcgaaaatattgcgtataaaggaaaataatatacgagcacgccgtttctttttttcgtccgcgacatataattttattaagttaaaaatgttggccttggtaaaaaaggaggacgaataagtgaaaacaaaccgcccgaaaaaaatagcaggatacgcggaattgttcgtcaagctgcacgttttgaccgaagagcaaaagaaagacatcatcaaatcgattaaaatccgctaaagcggcctaagtaagggcttcagcggaaaacagcgcttcgatttcttcttcaaatctatctgtgataatccctttttccgtgatgattccagagattaaatcgtgcggcgtgatatcaaaagcaggattgaacacaggcacctcttgcggcgctatttgcgttccgtttatccgtctgacttcatccggatcgcgttcttcaatcggaatgtcgtcgccgcatgaaatcgagacatcaaaagttgacaggggagcagcgataaaaaacgggatttgaaaggctttggcgaggattgccaagccgaacgttccgattttattggctgtatctccgtttcttgcgatcctgtccgctccgacaatgacggctgaaatgttcttttccttcatcgtatgggcagccatgctgtctgtaatcagcgtcacgtcaatccccccctgcataagctcccacgccgtcaggcgcgccccctgaagaacaggccttgtttcacaggcgtaaatatgaaggtcgagatcctttgttttggcaaggtaaaacggggaaagggccgttccgtacctgcttgtcgcgatcgagccggcgttgcagatggtcatgatgctgtcgcccgatttgaacaaatgcagagcattctgtccgatctgccggcatgtttcttcgtcttcaacctggatctgaatcgcttcgtggacgaggtttgtttttgcctcattgaccgattttgcgccctctgcgctttttaacagccgattgagggcccaggataaattgacggctgtcggccttgcctgattgagttcatctttgattttgcggagctcccgcagaaaagcggaaacatcagatgtatcgatgctttgtgcgcaaagggcgagtccgaaggcggctgttatgccgatggcaggcgctcccctcacttttagcgtttggatcgcatcatagatgtcttctttagttgtgagatgcaggtactccgtcttttcgggaagcttttgctggttcaggatttttaccgatgtttcttcccattcgacagaacggggcaccgcaaattgttccggcatgtcattcactccttaagcgcgtttcgaaacgcttcaatcatgtcttttggcgtccggaaaccgctgcgtttttctatgaatgctgcgcctattttaagggcgagctttttttggctgattctccgggaaaatggaacgattgtatcaaggtccgcaacatgggcgaggccgatcgtccggcggatcatttcgcagccggcgaagcctgctgcgtcttcaaacgcctgtctcaggactgactcaaggcgcccattctcatgtttgcaagtctcaacagcatcgttttcccatgcttcgctgaatgtccggctgaacgtattccagacggtctcgacatggcggtataaaggagcccgcctgttttcttcgcgagaaagcgcgtttaacagcaggttggcgataaactgtccgatgtcaaacccgatcgggccgaaaaacgcaaactcagggtcgatgattttcgtttcgccatcttcgccggcgaaaatgctgcctgtatgcaggtctccgtggatcagcgtttcctccgctgataaaaagcgctgcttcagttttgccgcttcaatttttagcgcttcattgccccaaagaacttctgcttcatcgcgaagctcttcttcgaaattgttcgtctcatggtcaaagaaagggtctgtgaacacaaggctttctgtaatatcgcacagatccggattcgtaaactgcttcacaagccgctctttaaccgttgggtcaagcgcatattctgatgagtaaaaatgcgtttttccaaggaattctccgatatcttccgacagatgcgggtaatccttcccgtcaatcagtccgtttctggcgatttccaagtgagaaaggtcttccaatacggtgacggcaagctcggtgtcagaatagtacactttcggaacaaggtgcggaacgtgctcagcctggcggatcagcgcactgctttcgattcttgccctgtcaagcgtcagcggccagctttcgccgacgacttttgcataaggcaccgcctgcttgatgaccaatcctctttgctgctctttgtcataaacgcggaagaccagattcaggtttccgtccccgatctctcggcatgtcagggtgcttttgcttggaaaaagcccgagacggacggcaagcgcggccgcggagctttcagtcaaagtttcgtatgctgcggtttttgttacggtcatgtgtgattccccctaaaatgtcgttaacaaataaaaaagcctctttctcgtcgagagaaagaggctgatttgtcgcgtacgcctctcttatctctcagaattcaaagtctgatggaattagcaccgtgccctagcggcgcagagattcgcgccccatttcacaatggtattacggtcggttgctgttgggatcattaggccagtccttcacccaactctcgataagagaaatcaatataaaattttgaaatttcagttcggtcagttgctgaacatgttaccagcatctccgttttcttgtcaacatttttttaatataaatctttgcgaatgtcctcaaaaaccggaatttgcccccgcgctttttcaatgtcccttaggtcgatttcggccctgatgaccgcttctccgcgtcctgcttcagcaagggtgcggccgagcggatcaatgactgtgctgtggcccgcaaattcgtttgccgggtcttttcccgaacgattgcaggctgcgacaaagcactgattttcaatcgctctggcttttaaaaggctttgccagtgatcgaggcgggcgagcggccactccgccgatacaaagatgatgcccgcaccttcgctcgtatgttttctgatccattccgggaaacggatgtcgtagcagatgaaccccgcagccggcatcccttcaagctcgaagcgcccgtcgcctgagcccgctgacaaatagaggtgttcgtccatcagctgaaaaaggtgagctttgctgtattctttgatcaaatgtccgtttttgtctgcgatgtacatgatattgtacacaccgctttttttcttgactgcgactgagccgcatacgatatggatgcggtttgcttttgccgtttcctgcagccatctcttcgtttgcctgccttcttcatccgcgatggagccgagattttttaaatcataacccgtcgtccacagctcaggaaggagaaggatatccgccttccggctttcctgctcgatcagctgctccgcttttttgaaattttcagaaggattgccgtacgcgatatcgaattgcaggcatgaaattgtcagcttcactctggatcacctcatttttttctttacattttacatttaacaatatatgatgatggactatcatttcaagaatttttcaaaagcgggtgaatcgtatgaaatttgagcattcagatgtactgaagcagctgccggagcagtttttcgcttccttggtcaaaaaggtgaatgaaaaaattgccgccggccatgatgtcatcaatctcggtcaggggaatccggatcagccgacaccggaacatatcgttgatacaatggcgcaagccgtccgcaaccctgaaaaccaccggtattcttcctttcgcggcagccgttcactcaaggaggcggcggccgcgttctatcaaagggaatacggcgtagagctcgatcctgaacgcgaagtcgctgtattgttcggcggaaaagccggtcttgtcgaacttccgcaatgtttgttaaatccgggggatacagtgctcgttcccgatcccggctatcccgactactggtcgggcgttgaactggcaagagcgaacatggaaacgatgccgcttacagcggacaatcagtttctgcctgactacagccggattcccaaggaagtgaaagaaaaagcgaagctcatgtatttaaattatccgaacaacccgaccggtgcccaagccacatctgcttttttcgaagagaccgtccggtttgccaagtcgaacggaatttgcgtcgtccatgattttgcctacggcgcgatcggctacgacggcaagaggcctgtcagctttctcgaaacggcgggagcaaaagacgcaggaatcgaaatttacacgctttccaaaacgtataatatggctggatggcgggtcgggtttgcagtcggcaacgcctctgtgatcgaagcgctgaacctttaccaggaccatatgtatgtcagcctctttaaagcagtccaagacgccgcggcggccgcgctcctatcagatcaagcgtgtgtccaggagcaaaatgagcgctacgaaaaaaggcggaatgcatggatccgcgcggtccgcgatatcggctggcatgcggatgctccgcaaggatcttttttcgcctggatgcctgttcccgacggctatacatctgaggctttttccgatctgcttctcgaaaaagcgaatgtcgtcaccgcgcccggcatcggcttcggcaaacacggggaaggctatgtgagagtcggcctcttgacaagcgaagagcggctccgggaagcggcttcgcgtattgccgagctgaatatattcaaaaagaccggccacagtcattgacaaccgggagaaacgatgggataattcaaaataatttataaaatcaatattcttatcaagagcaggcagagggacaagcccgatgaagcccggcaaccgactttttaagcacggtgctaattcttgcagctgacgctgagagataaggattcgaacctgaaaagcgaaacctcttttagctaaagcagcaaaagaggtttttttatatgcatgaagcaggaaggagctacagaatgagtgaacttttggcaacatatatcttggccgatccaggctgtgacgcagaaaagcgggccgagcaaatcgcgatcgggctgacggtcggatcgtggacagatctgccgctcttaaagcaggagcagctgaaaaagcataaaggacgcgtcgtcaacgtcgaagaaacagaaagcgagctgggggaaaaacaggcaacggtcaccatcgcctatccggaagccaattttacaaacgacattcccgctgtgctgacgaccgtttttggaaagctgtctctcgacggaaaaatcaaattggcggatttggagttttcgcggtcttttaagcaatctttgccgggtccaaaattcggcgtatacgggatccggaaaaaaatcggcgaatttgaaaggccgctgttgatgagcatttttaaaggcgtcatcggccgcgatatggaagacttgaaggaacagctgaggcagcaggctcttggcggagtggatttgatcaaggacgatgaaatcctattcgaaacaggcagtgccccctttgaaaaacgaatcacggaaggaaaaaaagtgctcgaggaagcctttgaagaaacagggcgcaaaacgctgtatgccgtcaacctgacgggcaggacaatggagctgaaagcgaaagcgagaaaagcagccgagctcggagctgatgttttgctgcttaatgtgtttgcctacgggctcgatgttttgcaaagctttgcagaagacgatgacatcccgctgccgattatggcgcacccggcagtaagcggcgcacttacttcatcgccgcattacggtttttcccattcgctcttgctcggcaaactgaaccggtatgcgggtgccgatttcagcctgttcccttctccgtacggaagcgtcgctctgccgaagcgagatgcgcttgccatatacgatgaatgcacgaaggaagacgtctttaaaccgacattcgcggtgccgtcggccggcattcaccccggcatggtcccgctcttgatgaaagactttggcattgaccacatcatcaatgcaggcggggggattcacggccatccaaacggggcggcaggcggaggaagagcgtttcgggcggtcattgatgccgtcttagaagcggagcctgtcgaagagaaagcaaagcgctctcccgatttgaagctcgcccttgaaaaatggggaagggttgaggtctctgtatgagaaagccgcttatcatttgcgattttgacggaacgatcacaacaaacgacaacatcatcagcattatgaaacaatttgctccagaagaatggaccgctctaaaagacggggttctgtccaaggacatatcgattcgggacggagtcggcagaatgtttaatttgcttccggccagcctgaaagaagacattacggcatatgtactgaaacaagccgagacccgccccggatttaaagaatttgtttctttcctggatgagaagggtcttccgttttacgttgtgagcggagggatggattttttcgtctatcctctgcttgaaggaattgtcggaaaggaccgcatttattgcaacgaggccgctttcaccagccgcaatatcgagatccgctggccgtatccgtgtgacggcggctgcggaaatgactgcggctgctgcaagccttccatcatccgccggctgaaaggccgggacgatttcgttgtcatgatcggggactctgttacagatgttgaagctgccaaatgttccgatttatgcatcgcgcgcgactatttgctgcgggaatgtgaagagctcggcttgaagcatgcggcattcggcgatttccgcgatgtaaggcgaatactcgaagagaccgcggaggtgaaagaatggatgtctgagcaaaaacggcaggaactagccgaggtaaaaaaagagcttgcggaaagggattggttcccggcgacaagcggtaatctgtcaatcaaagtatcagaagacccgctgcggtttctcatcacagcaagcggaaaagataaaagaaaagagaccgaggaggattttctcctggcggacgaagaggggaggccggcggagaccggacacgcgctgaagccgtcggcggagacgctgctgcacacctatgtctatcaacacacaaacgccggctgctgtcttcacgtccacacggttgacaacaatgtcatctcagagctttatgcaaaagaaaagcaagtgacattcaggggccaggaaatcataaaggcgctcggactttgggaggagcacgcggaggtcacggtcccgattatcgaaaacagcgctcatattcctgatttggcggcggattttgccgggcacctttcaggcgattcaggcgcagtgctgattcgcagccacggcattactgtctggggaaaaacggcatttgaggcaaagcggatgcttgaagcatatgaattcttgttcagctggcatttaaagctgaaagctttgcaggcttatcacgtttaactaaaaaagggggagaaagcatggcgacaattcggatccatgatgaacaaaacacgagcattgaaaaccaggaagaagtagaacaatttctaaagcggcaggaggtcatttatgaaaagtgggatatcacaaaactgccggccggtttaaaggaaaaatacgatttgaccgatgaagagaaacaggagattttagacgtctttgccgctgaaatcaaagacatttcagaacgccgcggctataaagcgagcgatgtcatctcgctttccgaccaaaatccgaaactcgatgagcttttgaaaaacttcaaacaggagcatcatcatacagacgatgaagtcaggtttatcgtcagcggccacggcatctttgcgatagaaggaaaagacggcacattttttgatgtccttttaaatccgggggatttgatctctgttcctgaaaacacccgccattatttcacgcttcaggaagaccggaaagtcgtggctgtcagaatctttgtgacgacagagggctgggtgccgatttatgaaaaagagagtgtgaaccagtcataaaaaaagcgtccccggggacgctttttatttgtttctgtcataaagagccttgatgtggccttcatgaaatgaaagatgcggtttttcattttgatagtattgaagacggtcaaatacagagcctgtgtgaagctcgaacttatggccgtctggatctgagaaataaattgaatctctgtctccttcattctgttttctgcccttcagcacattaacgcctaaatcgtgtaatttcttttcccagaacggcaaatcttcctgttggatcgaaaacgcgatatgggtgtaagagtcgtggatttcctgtcttttaatgtctttctcttcgttgaatgcgagccagatgccgttcaggtcaaaataagcggttttctcggcttttacgagccacttggcatcaaacaccttttcatagaatgaaatagagacggacaggtcagagaccgaaaacaagagatgattgatgccgaggattttattgttttccattgtaatttactctccctgttagatgtgtttcaaacccgtccagctctttggtgatttgcctgaagagaaaagcgagcacagccgcatcatcaagccagccgacgcctgcgagaacatcggggatcaaatcgatcggtgacagcacatagataaatgccagcgcggccagcaaaattgtttttttcgggaataaggggtagtctccctttctccaggctctaaatgccctgaaaaacaataagaggcctgaatatgcttctttcacggcaaagacggttcggagctttgaaactggttttttcatcatttggcgcatcattggacctccttctatccgtatgaactcttttaaaggtggtttaccatatttcatcgatgggtataacaccattaattccacaaatctattatactcgatttcaaaatatttttttcggaaataggtttacaaaataagtataatctgtaataatgctcaagtacgcaaaatctggatggttttaagaaacgatatgttggtaaggggtgaagcgtatgcaaaggtatattgaaaaagaagcattgctcgtttccatcagcaagaagcggcaaatgatggttgaagccgctgaaatctatggatatacaggggatgaaacgatcaggcggagccaggagctggatcaattaatttatgaatatcaaaaattgtctatgaatgaaaacgcgccagacaatctgctgcaagattttttaggctgcatcgactgtctgcccgttgaaaaatatacggcatagcggatgaacgaaaaagagctgccgtaaggaaggcaggctcttttacaggaacggggaaacctcagtcgtcctgttcctttgaagtcggcagcgtaatcgttacagtcgttcctttatgccgttcgctttcgatatgaatggttcccccgtacatggaaatgatgcgcttgcacacgacaaggccgagtccggttcctttttcttttgatgtaacaaaaggctggaaaatactttccatcatttcttgtggaatgccttctccgatatccttcacaataatttgcgccttctcttgatcatgttcgatttgaatgaccagctttccgccgtttttcatcgattcaagagcatttttggcgacgttcaagacaacctgcttaatatgatcctttttacaatacacataagccggatcttctccgcagtcttgaaattccacttccacattatataaatttgcctcagaatgaataatcggcatgatctcgtcaatcatttcattcatggagttgagctgccactgctctgccgtcggctttccgagcacgagaaactcgctgacaatctggttgatcctccggatttcctggtcgatgattgagaaatacatttgatcttcttttgattgatattttttttgaaggagctggataaagccgctgatgcctgtcagcgggtttctgatttcatgagcggtgctcgccgccaaggtgccgattaattcgagcttctgcgcttcattttgggcgcgctcctgcttggtccgccgcttcagcaggacatactggagcaggaggaacataatattcagcagaatgaaaatactcaaaaatgacagcagaagactgtgaacgatttcatcaagctggaccggttccggatagacttcaagcttccagtcgatctggtccaaaaaagcgtcgacggtaccgccgtccggcttctcaggaggagaatggcctgccgtaaagacgatctgattcttctgattgagaattttgatataaagctcagggctcaagacgttcatgatatttttcagataatcgacgcggatcgaagcgagcagaaaatttgttgttctcccttcgctgtcaaagaccggagtaaaaatattcagctccagcccgtccgacactgtatgtatatcgtctgtgatcacggatttctttgatttttccgctttttgcagaatgctcttgtaagaaagcgcctttttttctttggcgggagacgtgctcaccatgacatcgccgtcttcatttaaaaggtataaagccgaaaaacgcggttcttttttatacgtttccgtcaggattcgtttgatatgctgctcattaacagggtggttgagggccgtggcaagggagctgagccttgcttctgtttcgccgatcaggtaattgatttggttgcggtgaatattgagcatgagagtcgcagtctgacggtgcttttcagtgatattttctcgttcttgttcgtatacaaaaaagcttataatgaaggcggggatcatcaccaagatcaaataaagcctgattttcttccatatacttttcaaattgcgcatgtttttactctctcccaatcgatacaggaatagaggtattatatcactagtgagagccgatttatagaaaagataaccaataccgtgaaaataggacacaatgccggggaatttccggatatatctatttgctgttcaattcctactcatcataacatggtttgaatgttaacagttgacattttcctcatagtttattaatgttttcctgtagttgtttctttggagatgagtgatatgagtaatagagaacaggaacagtccttgaagttatttattgtattatctcgagcgtacagatccattaatgatcatatgaataaacatattcatcatcatggtctgaatccaaccgagtttgccgttttagaactcctctatcataaaggggatcagccccttcagcaaataggggataagattcttctggcgagcgggagtattacatatgtggttgacaagcttgagcaaaagcagctgatcacgagaagagcctgtacgacagaccgcagggtgacctatgcgcaaattacagataaaggcaccgagctcctcgagaagatttttccaggtcatgcagaagagctgcacaacatgatcagcgtattaagcgatgaggagaaagaagcctgcatcgaaatgctgaaaaaagtcggactgaatgcaagaaatatttataagggcaaagagtaaggaagctgccaaaagacagcttccttattcttttttattcagattttcctggccgatcggcaggataaggatttcaacgcgtctgttttttcttcttccttcttcggtgtcatttgaagcgatcggtttaaattccccgtagcctttcgcgctgaagatcttggcgtcaagctttggattttcgattaaaagccccatgaaattgacagcccgcatcacgcttaaatgccaatttgatttaaattgagaatttcgaatcggcacattgtccgtatgcccgctgattacgatattgcggggcgggttcaatacgagaaggtcggatacttccttggccagcggaatgtcctgctggcggatctccgcttttccggaatcgaaaaagatattatcctcgatggaaaggaggaggccctcgtctgtcagcttcgtattgacctgtttttgaagattcttctctttaataaaccggttgacctgctcctgaatttttttcagcgactgcttgtctttttctttttgagcttcggagagatcttttgcctggtcagggctttttccatcttcggttgtgctcgttttcggctcggtgaagctggaataatccatcattcctgttccgccggtaaatacggcattaaatgattttgacagcatatcgaacttcttggcgtcgatcgagctcatggcaaacagtacgatgaacagggccaaaagcagtgtcagcaagtctgcatatgggatgagccaagactcatccacgtgttcttcatggtcttttttgtgcttcttttttctagccattgctgctgtcccctttgtctccatctgggatgacgatgctggagcgttcgcttggagaaacgtacatcaaaagcttttgttcaatgacttttggagcctggccttccaagatcgaaaggatgccttcaatcataacttcgcggactttgacttcctgtttggatttccgctttaatttattggcaaaaggatgccatagtacatatccggtgaagatcccgagaagggtggcgacaaaggcggcgctgatcgcatgtccaagcgcttctgtgtcgctcatatccgcaagtgcggcgatcagtccgacaacagcgcccaaaacgccgagtgtcggcgcatatgtgcctgcctgggtaaaaatacccgctccgacttgatgcctttcttccattgcttcaacttcttcagttaaaacgtccctgataaaatcggcactttgaccgtcaaccgccatgctcatgccgtttttcaaaaattcatcatcgatctcattcaaatttgcttccaaagcgagaagtccttcgcgtcttgcgatttgcgcccactcggaaaacatcgggatcagttcgttgatttcgatcatcttcttctctttgaacaagatgccgaagagtttgggaacctttttgagctcgcggattggaaaagcgatcacaactgctgcgattgtcccgacaaggatgatcagccatgccgcgggattgacgagaacggaagggctgacacctttcatgaccatgccgacacctactccgatgatagctaagatgattccaattaacgatgttttgtccattttttcaccaattcctttaactaacttttctatcgttaatatcggtgttgcgtgataggaactttaggctgtttcttaaattgttgcaaaatcatggtgaaaagggactttagggttatttaatgttaaaaaatagaacttttgtgattcttatgttgtatgtaaaacgacctccgcgatcggaggccgttgtgtgtgttatctggttgttttcacccggatttcatcgttttcaacgataaccgcaaaacctttgatgtgttcttcttcaagcagcagatcggtcatttgatcttcgaccgctgtttgaatggttcttcttaatgggcgggcgccaaaggccggatggtatccgatttcagcgattttttcttttgcctcatctgaaacttcgagcgtcatgttttgctcttttaacgtttcttcaagctctttcagcaagagggcggcgatcttgaccagatcttctttttcgagcggctggaattcgatgatgctgtcaaatctgttcaggaattccggcttaaagtagccgcttaatgaatcgatcattgattgttcgcccattacttgctcttcccggttaaaaccgacggttgtccgcttttcagatacaccggcattgcttgtcataataatgacggtatctttaaagctgaccgtccgcccttggctgtctgtcagacgtccgtcttccatgatttgcaggaacatgtgctggacatcgggatgggctttttcgatttcatcgagcaaaacgatgctgtacgggttcctccggactttttcggtaagctgtccggcttcttcgtggccgacatatccaggaggtgaaccgatcagctttgatacggcgtgtttttccatgtattcgctcatatcgaggcggatgatggcatccttcgtgccgaacagttcttccgcaagccttttagaaagttctgttttaccgacacctgtcgggccgacgaacaggaatgaaccgacaggcctgttttttgatttcaggccggcgcggcttcttctgacggcttttgccacttttttcaccgcttctttttgaccgatcacgcggcttgaaaggtttgcttcaagctctttcattttcttctgatcgtcgtgctgaagcttgccgaccggaatgccggttttttgttcgatgatcgcttgaatgtcttccgcttcaactgttgcccgtttttcttcctcatggctttccatttttttatgcagcgcttcttcttcgtcgcggagttttgctgcaagctcgtagttttcttcttgaagcgctttggctttttccgcttcgatttcttgcaggcgttgggaagcttgttcaccgctgaccgtgtcgattttcaagttcgcttttgaaccggcttcatccaaaaggtcgatcgccttatcgggaagatggcggtcctgaatatagcggcttgacagaatgacgcaggctttgatcgcttcatccgagtaagtcacatcgtgatatgcttcgtatttttccttgagaccgtttaaaatcgctgcggcctgctcaattgtcggttcgtgcaccatgatcggctggaagcgccgctctaacgccgcatctttttcaatttggcgatattccttcaacgtcgtagcgccgataacttgcagctcgcctctggcaagtgcaggttttaaaatgttgcccgcatccatggagccttctgcagagccggccccgacaagaaggtgaatttcgtcaataaacaagattgcgtttttgcgttctttcagctctttcatcagctgtttcattctttcttcaaattgccctctgatgccggtgtttgccacgagggaagcgacatcaagcaggtagagctctttgtttttcaatttatttggaacatcgccttcggcgattttgagagcaagtccttcagcgacggctgttttaccgacgcccggttcaccgattaagaccggattgtttttatttctgcggtttaagatctcgatcacacgggctacttcatcatcgcggccgatcaccggatcgatcaagccggtctttgctgcatttgttaaattgacggcaagttcatcgagcaagccttttttggcagcggtttgcgtctgcgcttgtgatggctggctgaagaaagaacctccgccgccaaaaaagtgatttcctgaaaacatagaaggctgagtcagctctttatagcagtcttcacataaatccatttgtttttttgtaaagttgatttgcatgtttaggcgaatcgtcgcctcatttttttgacaatgttgacaacgcatttgccaaaaccccctttattgaatttgaccttttttgaccaattgacttagaaaaaatggtctgcagtttgaccatttctgactattagtatacattgaccttctttgactttcaagttctatgctttttcctttttgttcctggatgacctggatgagaagttgtccttctttttgaaggacatggatcatatggtgtagaaagggaattcgcttacggaggagtcgtatgagtcaatcacaaggatcagcctttcagctggcatttgtttatgtaggaacggttgtcggagccggatttgcaactggaagagaaatcgtcgagttttttttaagattcggctggccgggattggccggaattttgatcagcggactgatgtttacgtttctcggtgcaaaaatgatgctgattgcggtcagaatcaatgccaagtcttatcaggagctgaataaatatttattcggccatacgcttgggaaatttgtcaatgtcttcatgctcgtggttttgctcggcgtgacgtccgtcatgctgtccggagcgggggcgatatttgaagaacagctcggcttttcaaaccaagcggggatgattgcgacgattgccttgagtctgtttgtcatgatgaagggcgttaaagggatattcggcgtcaatgtcattgtcgttccgctgctgcttctgttcacagttgtcgtcctgtttgactcgtttattttcagagggccggagatacacaatttggcggcattttcggcaaaccccgattggattttatccgctgtctcgtacggcgcttttaatttgtcgctcgcacaggctgttctcgtgccgatcgcttctgaactgaaatccgaacgcctgattataaaaggagcattaatcggaggggttctgcttacccttgtgttggtcgcaagctttctgtctctttcaacattgcctgatgcccttttatatgaagtcccgatggcacaggtcgtattcatagtccagcattctgtccatatcatctatctgtttatcattttcggggaagtcttcacatcagtcatcggcaatttatacggtcttgaaaagcagattaatgaatatattcatataaaaagcctgtatgtgtttatcttcatcctgctgacaatctacttgacgggacaaatcggctacggaaagctgatatcgaccatttatcctttgttcggccagctgagcctcgtctttattttctttctgatcgtcaaaagggtgcctgagcgatgactggcaggcattgcacttggcgaaacgtgcgatttgtgataagatggcgaaggaaaattgaaataaaatccgcttgaaactgcgggagaggttctagcaaaaccctctataaaaaactaaggaaagctgtatccttggggtatggccttttttattgtttttttgctagagcacctttctcacagagaaaggtgttttttcgtttagatatcattgaatctcttcttttatgaaatggtgacgaaaagcggagaaggaggaactatgaaacaggaaaaagcgatcgtcgtattcagcggcggtcaggacagtacgacttgcctattgtgggcgcttcggcaatttcaggaggtggaggcggtcacgtttcaatataatcagcggcacaagcaggaaatcgaagtcgcgaaaaagatcgctgcaaagcttggcgtcaagcatcaccttcttgatatggaactgttaaatcagctcgcgccgaatgctttgacaagggatgatatcgagattgaggcgaaagaaggcgagcttccgtccacttttgttccgggacgcaacctcgtgtttttatcgttcgcttcgatcctggcctaccaggtcggcgcgcggcacatcattacaggcgtatgcgagacagacttcagcgggtatccggattgccgtgatgagttcgtcaaatcctgcaatgtcactgtcaacttggcgatggagcgcccgtttgtcatccatacgccgcttatgtggctgaacaaggcggaaacgtgggagctcgccgatgagcttgatgcgcttgatttcgtgaaaaacgagacgctgacgtgctacaacggaatcattgccgacggctgcggcgaatgcccggcctgcaagcttcgcgcaaacggctacaatgaatatatgaaaatgaaaaaggagcgagcttaacagtgcttacacaaatttatccgcaaccaagccatccttactcttttgaattaaataaagatatgcaaatgtcagctgcacattttattccgagagaggatgcaggcgcatgcagcagagtccatgggcatacgtatacaatcaatattacgattgccggggatgagttgaatgcatcaggtttccttgtcaacttcagcaccattaaaaaattgatccacggagaatacgatcatacgcttttaaatgatcatcaggaattttcaggtgaaagcgcggatcggatcccttcgacagaagtcgtggccaaaacgatttacgataaagtagaggcttatttgaaagatctcaacaaccgtccgcattgcgtccaggtgtttgtcagggaaacgccgacaagctatgtcgtgtaccgtccgaaaccgggtgttcagcatggctaagccgattcccgtacttgaaattttcggtccgacggttcagggagaggggatggtcatcggccaaaagacgatgtttgtcagaacagccggctgtgactattcgtgcagctggtgcgattcagcttttacctgggacggttcggcgaaaaaagacatcaaatggatgaccgcggaagaagtgtacgaatctcttaaagacatcggcggaaacgcattctcgcacgttacgatttcaggaggcaacccggcgcttttaaaacagctggacggactgatttcccttttaaaagaaaacggtatacggacagcgcttgagacgcaaggaacgttttatcaagactggtttaccggaatcgatgatttaacaatttcgccaaagccgccgagctccaatatgaaaaccgattttaacaggcttgatcatattgttgacaggctgaaggaacacggccgggcggctgcggcaagtttgaaggtcgtcattttcacggcggacgaccttcaatttgcaaaacaagttcaccagcgttatcccgatatcccgttttttcttcaggtcggaaatgatgacgttcatacagaagaccaagagcggctcgtcgaacggctgctccaaaaatatgaacagctggtagaagcggtcacgcgcgaccctgaattgaaccgcgtccgcgttctcccgcagctccacaccctgatctggggaaacaaacggggtgtttgatttaagaaaggaagatgaatgatgacgacaagaaaagattcagaactggaaggcgtaacccttcttggaaatcaaggcaccaattatttgtttgactattctccggaagtgcttgagtctttcccgaataaacacgaaaacagggactatttcgtgaaattcaactgccctgaattcacatcgctgtgcccgaaaaccggacagcccgattttgccacgatctacatcagctacatccctgataaaaaaatggtagaaagcaagtctttgaaactgtatctcttcagtttccgaaaccacggcgattttcacgaagactgcatgaacatcatcatgaacgatttaattgagctgatggacccgcgctacatcgaagtctggggcaaattcacgccgaggggcggaatctcgatcgacccgtacaccaactacggcaagcccggcacaaagtatgaaaaaatggccgagtatcggatgatgaaccatgatctgtatccggagacgattgataatcggtgatgatgcgggcagatgaagcgaaggtttgtgatcgatgtgtgaccgagacgcgtactgttacgcgtcttttttgttcgaaatttccacgaacaattaccaagcgtattggtcgaatgctagtccgggtatatgaaatacgattcgaattgttaattgaaaggtaaagaggaggaaacttcgtcgtcactcgcctcgttaacgtctccgcttgacagttcgtcgttaactgcgaatgctctagcgttcggtatttagatggtttccgtctgtttttagtcttgtttgttcatttattcgtgaaaaaatgtagctttgtcctcatgttacaaaggatgttttctgttttttctttaaacataaaaatctagttattctgactttgaggaggggatgggaggtatatagcagagacgaagacatagtgccaagagcatgtcttattcgtatacacacaaatatgtaacgcgaagatgttggagggcttacgaaagaaacaatcgatcgttatagacgggaggagcgttgaagaatttgtggaggcttttaaaggaaggttggcactgagtcggaatggtatacgttaatcttaccgacagctgataagaagttaatcacgatgtttaacgttaagaaaccgtagaaataaaaagcgccccacatttggggcgtttcttacgtttgcttacgggtagcgatttgatatacgccgtcagactggtcggttgctgaaacaacgctaatacccatcgttaataacgcggcggctaaaatgggaataacgagctttttaatactcatagagacactccccttttttaatttttgtttgcccatacatcattttttgaaggaactcgattgagtttctatggtcttttctttcaaggtattggttagagacttcaagcgaaagctcttctatgtatgcaaatattttattctcctccaagtatttaaatacctctaaaatctcttctttattcacagaatagatatataacgcctcaagatattcaaatagagaagtgaatagggtatcgttgaattttcgagctgtttgtctaaccaataagaaatatctcgattgcgcgctcgtagtttttctgcttaaaaagaagttgagtagagtaatataatgattgtggtaggttgttatattcttcttttagattaatctctacggctttttcagcatattcaactgctgcatcaatgtctcccatacattcatgacagtcggctatattaaaataggcagaactaatgagccttttattgtcgatctctatcgctaattcaagtgcattttccaggtggggtaaggctttgtcatggcgcattaaatcgtcatagttacccgcgataacaaataaacattggattttacggactgtgtagagttcatgattattgtatattttaaaggcccttaatatatgatacatgtgtctgtttcatgatgtagtatgcttcagccattttaaagtgaaactcggcttgttctataacatcgtaatgagagccaactgtttttctgcgtttcgataaaactctattgctttgatgtactgttttttctcaaattcatacatgcccctaaagaaaaatgagtagtaactaaggaggccatttaaatctcttcgaggctcctcgatttgggccaacaatttgtttattgattgtccttgttttcttttgttagtaggttctaaatattctaacattaattgatgtctaaaacacatcaactgatagtaaaggagtaagtcctgatcttcttccatttgattaatttccttctctacttcttcttttaaagcctctgcatccggtacgctaaactctcttatcattttataccattcgtggattttcactccgacttttgacgagggtattaactgtttcacttccgcctatacctttttatttcatttttgtaaatatattactataattcgggtgataataggttgaaaagtgaaaaaattttcggtatgccgcaataaaatcagcaacaaaaagacgcctgctaagacgcctgaatctctatatgctctttttcaagccgcacctgcagtattctcgaagggaaatttcgtccaccgcgatcttgaagggtttactatttgaaggaatttgcggataaaccctgtgcatccatgaaaatgaaacttggcctaataaagaagtaattcgatttgtgaatgatcaacttaaagaaaatattgatcttttattgatgcctgcaacagcttccacagctcctcgaaacccttttaaaataaagagttataaaaattgaccagcatccactctagtggaatctttccccttcacctgttttaacgtggctacgattagaaagctgacaatcactaataagagccatgaactcactttccctacatgaacgagactccacgtactggtttggtttggatatgtccaggccccaaaaaacgttgcgatattttcggctatccatataaaaaatccgatgagcacaaaagaaagtgcgagcggcatacggtaacgaatcccattaacctcgtatatgacccatgatttccaaaagacaattatcacaagtccagataaccaaaagcggacgtcaatccaaaaatgatggaggaaaaaatttaaataaatcgcagcggccagcggtacaacgacgtaaaacggcggccacttaaccagttcaaccttgagcctcctccaagcctggcaaagataactggctacacttgcgtacataaagccgctatacaaaggcaccccaaagattttggagtaaccttcctccggataagaccaggagcccatttgcaccttgaaaagctcaagagcaagtccaataatgtggaacaatgtgattacttttaattcatcccgtgtttcaagaccggaacgcaccatccaccattgcatgagaacacagatgatgagcagcaagtcataccgcggcaggaagggaagaggtatgatttgtgtaacagccaaagaggcaaaaataacgacaggaaatacacatgacaaggactgctcccaaccaaaacgaacgagttgttttagtgctctcatgatgtgtgcctccgaagtttttttctgaatatatgcgaggccagcttagtatagcagctaaaccggcttacaggtatgcgcataggatcaccgccaaaaaaatggtttctttccatattaaatacttttttaatcctgggtgtcttcatcacttcggtattccaaaatatctccgggctgacattctaacgccttacaaattgcctctaaagttgataatcgaatggcctttgcctttccatttttcaatatagaaagattcgccattgtgattccaaccttctcagaaagttctgttacactcattttccttttagccagcatcacatcgatattgattataattgccattgttatcacctcagactgttaaatcattttctgattttatatcaatcgcttcttgcaatagcctttggagaacagcggcaaagactgcgataaccattgaagcaaaaataaggaccaacccgatcagtatgatccctggagcgtcgtccatctctgcgataagatagaagagcggcatgcctgccgcaaataaaatactgatggtgattgcacagtattttatattctttaaagcccgtacagataattctgagaaagctttattctggtcaatatagcttaaaagtttaaaggcttgatacagagcaaaataaaaaggtatcgccgctgcatacaaatcggcatatacgagatatttcaaataagaaatacccggatacaattcggctgcaaaattcgctatttccggcacaaaaaatatgcacaaagcaagaactgggattccaataagaataacagctatctttaaaaagagagttgatccccgtttcattaaaagcacctcacttatttttgtcgatttgaatttaacacattatttatcgttttacaataaaaatatattgaaattgatgattttattattgttatggactgatcttttgatttttagacaagatggcgttacttgcggaaacaaagccgacacgtctgcagagtacacacacatcttgcagacctctacggcttccgcttatatgcaaataaaagccctaaatatgttaagcgcgtactgaatcctacagatcgtcgaggagtgaaaaagaatcgatttttcccaaacatattttgaatttataatagaatagctttaaaggaatatgtatcaacaagtcgtctagcatatgttgtgttataaaataaaacagctggcgattggcgtgtctttccttttaacgtgaatagtcgaggagttatttgaggtgaagcagaagacgctgacgcatgatcgacgtctttttattgtggtaaacacagagcagagagtcttgttagattaaattaaaataagacgccaattaaggcgccttcatcttgtcttaaatccattcacaaaactttctccatccttctctgtcgcaataagctgctgggcgctttgactgattcgctgagcaagcgcctgctgcgcttttccttcgaagctgtagagaagcgatgaataaacgctgttcatttctttttgtatatcgtctattttaaacttcggtcttagcgtcgttttaatgccttcaagcttagttgcggctgttaccctcatgcccgttttcagcatttgaagctgattgcgccgtatgaagagggtagcttcttgatctcagtttaagttgttgagtgaagccagtctgttgaaattttccattgtttcatctcctaaagtttaagccaatttgccagcattttatctttcgatttaaaatcttttgcaatctgcgccaggtatccgctgatgtcttctaaatctgaaatcgtgtcctttaatgaggcgatgtaagctttttcggcatgaacatcgtaaaatagcggattgccttttttgtcaaacgactgcgccaggtttttcagcgtattgtttacatcctcgagtgtcagcttgtcgtataaaccgtggccgacttgacggtaggtatcgtgcttcaggtcgttgatctcggcgtcgtgttcctgataagcgttttcggcttcccgtttcatcgtccgcaagcatttactttttgcgcgagctgcttggcaacttcgggcgttactttaattgcgccacttccggatgcaacttccggtggaagcatcgcttttaaatttttgtcataaacgagttcatcgccctctatattttgaacgttgccgttttcgtcgaaggtaaagttgcctttgttgaggccgtgtgtatccggcattcccattgctgtggtagcaatgtagtctacagcgacattaaacactgtgccaaatataccgccgttatacttcggatctagtcgtatttgtcgttccacacgcgaagtagaggggtctttggtatatattgttctgcctgcgtgtcgttcgtactcattccaccagccggaaccagtcatatcatccggattgacaatcgcttttacagacgagtcatatttgccgcttcggatctccttttgcttttcttcagaatgcaatttaacgacggaaggattgttgaatgcgactgcgtatatatcattgttcacagcgctgtattcagcctctgcgccgccaagagagtgtccggtggttgaaataaccgtcgaggtgcctttatacttttgtttaacttcccgtaccagatcatcagcttgcccgatttgggacgttttcgtaattaatttgtatttaccggtgctaagcatcgcgtcttgtgagggggttgcgttgtattttcctattgtttttgatgtatccttcgcatctttttcgattatgtattgcgatttctttttcggatcaagacccataacaacgttaccgccgtctgcatcaataacatcttgaaaaaactgttctttaggatttgttccagcgaaggccacgacgacgttttctggtgcgttaggtttaacccatttaccgtcctttttctttgcttgaacaaaaacatacgcatcaagtccagtgtcagagtcccttttaattttatcaacaaaaaaagccttatttgatttactctctataggtgttctttccttgaatgcttctttcattttatcggtactatatgtgttttggctaagaaaataatactctttatctgttaatttaggaatatcgctctttttattcaggtacataaccccgcaaactatgtaaaatgtaacgtggaaaggatggttttatgaaaaaatacataattatccttcttgctctggtcattataacatctggaggaatatttatgaagcaacaaaataataacagagaaaaagaagagctttataatttagctaaggaaagaatgacagactttattaaaacgaattataaggacattaagtcaattgattattatgatgactacgaagtgaatccaatgggcggaattgatattaaagggtatctaaatgatgataagaaaaagaaaatatggggtatttacgataaggcaaatgacgaagttgggtccttcacagtcgatgctgaaagaaagcccgaatataaagataaaatttgcgattattaataaaaggcccgactcgattgagcgggcttttttctattttcatctctcgtttgtttaactaatcggtttttattaccccttttaggcctcctcaacataaaatagttcttcagtaggcacgtttaatcctctaaaatggataaattgcagttttgggcatttttttcacctagaacgaaagaacttaatgatgcgaattttattagttctattgtcctgttttatatattgagtaccaaaaatgcactccatatgttttataatgaagcgggcctaacaatcagcaaacatggagcggaatgcaataaaatcgtataagggcatgcagtatgaactggaggatacatttttgaaatataaaaaagcagcagcacttggaattggtttacttttatttataggcggatgtcagaagagcggggaagctgaaatcagcgtccaagattacacaggacaggattttcatattcatagtagaggttatcagaaggaaaccgctgagatcgcagaagcgcatcgagatgaagttgaaaaaacggtaaaagattattttttggatcaatatagaacgaaggtaaaagtccataacattgtcggagggcatgggtttgttactgtgtatgccgaatcagtcggaaacttgcatttctacacaagcgcaaaaattgaaattgatttggacaagaaagaggtgcaggctgacgcgatcagctcatcggagtgggacgtaaaagactcgattacaagcgcgatatatgcgttggcttttgaagacgaatttgccgctctagattactatttagagaagctggcagaagaagagccggttgtaggtaaaacgcaggcagccgttgataacacaagcggtatgggatatcagacgccttattatgctgtttctttaaatgctgattggaaggatgacctttattcagcctatttagaaaacccaaaaagaagcaaaaaagactggcaagagaaattggaagatgaagaaatcaccccaaaatcatgtgatatcaatatacggttatatatgaaaaaaccaaatacaagaccggacgagcgcatttataatcaagttgtccaggatatcgaggacatggaagagctggccccggggacttacaccatttacttgagtgacaatagaatcaacaaaaacctaggatataattcaagaaaaagcacgcttggccgataaggtcttcctaaccgataaagagattggaaaccgatcaattttctgtatggatatgagcgggaaagaaaaagtggagatttcatcatctattttgaaaaataatgtcctggggaaccgttcgggtgtttcatttcgcacagtcgccgttttttcagctgtccaatcaaaaatcgattaaggcgctgtgcgatgcttcaaaagacatcctgaacatatcaaacttcttcgggatgatgcaggggacagaggaaaaaaccgccggaccaaggtggcaggcggttttccttttgtagaaaaacttgtggaaataaagcttcgtggaaatcgtgaattttttgctgtgaagggcggctgattaatgcagggagtctttaataattttatagtttttatgattgacgacggttaaggagtccagttccaagtctctgtagttttccataatcgtgacatcgacgatcacagagttttcgtttactttttctacgattccggtgagtccgtttttaaattcgatgacattcccgacttttgcaattttcaagtgacttcctctcctttaaagtaaattaacctattgaaagtattttgcaatattttcttggagaagtaaagcgatttgggaagcggcatcactattgttgtacccggtgtgacttaatgatatagttaattagttaaagatgatgagagaaaaggggagagaaaagttgacagagcaaaatgccatcgatcagatcgagcaattaaggtcagggagcattcatgagctccgtgtgaaaaaagaggattttctttctttcagagccatcttaacaaagcaggaagattttaagcattttcgcggcattgcccagcatggcggagatattatatttcaatatatgaaagaggcaagaagctgaaaaaagctttctcagacaggctgagaaagctttttttatttgtgtgaagccatatgtttctggagattttggtgttttttgcatgaaatccgccggctgtctgcaataatgtgacagccgaacggtttgatggaagtcatgccaacattttggcaatgaaatcggcgaatcgtcttgttactgtaaaacatatgtttttttcgatgaagatttgacaaggaggaaggaaatgaaatcgaaatttgctgctctagctgcgtttttaatctgcatgctgccggcggcaagaatcgagcatgctcaagctgtcatgttgttctcgaaaaaagataaacaggaaatggaacggctgatggaaagccttaaacaagaagaaaatcctgctttttcccaattgacagatgagaaaagcttcattgaagccgcgcatctgtcagctgaagaggaggaggaaatagaagaagctgaagaagagacgactgatcttacacataaagaaaaagatcttttatcaaggcttgtacacgccgaagcgaaaggcgagtcatttgaaggaaaagtggctgtcgccaatgtcgtcctgaatcgggtgaaagacagccgatttcctgacagcgtaaaaagcgtgatctatcaaagaaacgcttttgagcccgttctaaacggcagcatcgagaaaaaagcagaccgcgaatcagtggaagctgtggaagaagcggtagatcaaaataaaaaagaaacagaagctttatttttctataatcccgacatcgcttctgatgactggattaaaacgagaaaagtcgtgaagcgcatcggcaatcatgtctttgcgatctagaaagcagtcagggccattcgccttggctgctttttttgtgcgattctttcttacgcattatcatctttcacagcccaagaaaaaatttatttttgatactttatgaaaatcaattttcaattaaaaagaaaataatttttagacttgtctcatatgatgggataaacccgtgagacaaggagagacctcatgaaccgttttgtaaaaggaatcgttcttctttcgctagctgctttttttgcagaatgtcttgaattcgtcatcaacatgattcttgcacgggagcttggcgagcatggcatggggctctacatgagtgttttgccttccatttttttggtcgtggtgattgcgagccttgagctgcccgtatcaatatcgaagtttatcgccgagtccaacccgaagctgcacgaaagcatgctgaaacatgcattgcggatgactgcggtctgcacggttttctccacggcagccgcagtgatcattcttccatttattccggtttttgattcttaccaccctctaatcagaggacttgtgatcgggatgattcctacggttgcattcacatcgatcgcgagaggctacttcatgggcgttcagcaaatgggtaaaatcgcaacggcgaatgccttgaaaaaaatctttcagctcatcggcttgtttttattttttcaatggtattcctttgaattggatacttctcttctcatttcattgtttgtcctcgttgcaagtgaagtggtcgtgtttgtttatttgttttcgcagtttgttttggtcaggcgtgccgctcaaaaagggcagcagatccacttgcggagaaacgatgttttaaaacgcctgctcactgtttcgatcccgacgacggggctgcgcgtgtttcatgctgtgacaaatgccgtcgaaccttttttggtgaaggggacgctgcttgccgctggcgtatcaagaacatcggccatcgaccagttcggcatgctttcgggagttgcgatgacaatcggcttttttccggcttttatcgcccattcactgatggtcgtcatgatcccgagcatttctgaaagctacgcttacgggcaatacgaaagagtgatcaaacggattaaacaggcgatctttattacgctgttttacggcataccgtccgtcatggtgatgtatcactttgcagagccgctgacccatttatttttcgattcggtcaaggcgtcgttttaccttaaaatgttgtggccgtattttttattccacttttttgcgatgccttttcaggcctgtttaatcggaatggggttggccaaagatgctttttatcataacgtttgggccagtgtcttatcgtttttgatgatgtatgttctcgggtccatgcagactttgcagatgacggggatcattcttgcgatgaataccggtatgattttgctgacggcgctgcattatgtgacgatttgcaaggagctgggcgtcacgctttttttgacaaacaaatcccgatctccgagaattgaaagccgctgatggatcctcttcatagttttagcttttgcggggaagctaatattaaaaaagaaggggagttcccatgcgaagaatcagtctcatttacccgctcatcctgctgttttttaccgggttattcgtatttcagccgcaggcatctgcaaaacaagcttcgccggcagtcatgcagatgaacacggtcgaaggtcagcgcgtcgtcattcccgccgaaggccagaagacgatcgttcatttttggacgacctggtgcccgccatgccgtgaagagcttccgcgattccaatcctactatgaaagcaagcaatccggcgtcaagctcgtgaccgttaatttactgaatgccgaaaagaacgaacagaaggtaaaacagtttattaaagcaaacaagctgacatttccgatcgtttttgacaaaaagggtgagatgatgaaagcatataaagtcatgacaattcctacgacttttttctttaatgaaaaaggagagctggagaaaacgtttgtcggccccattactgtagaacagatgaaggaatgggcagggaaaagctgagccgggagttcagctttttttaaaatgtaaatgataattaatatcataaagaaattataataattattatttgaaaacgtaggatgtcgtgctataatgagaaatagaaaagggtgtgtccaatggacaagtagcagtcataccctttatataaataaaatacttaatgtttatgctgccgatgaggcggcaatttgttttttaagaaggaaattgacgatgaattacattctcaattagggaggatattggagatgcaattagagatcgggaagcaatcgcagcaaaaccgtcacacgttgcaatttgaaaattggaggcagcacggggaattgatagctgcgcttttgtcgggtttgttgattcttgcaggctggctgttgtccggcaatgaaacattgtccgttgttctgtttattttagctttttgtatcggcggctttgctaaagcgaaagaaggtatacaagaaacgctgtcggaaaaaacgctgaatgttgaactcttgatgatttttgcggcggtcgggtctgcgctgatcggctactgggctgaaggggccgtgttaatttttatcttttctctcagcggagcgcttgaaacgtatacattaaataaaagcaaacgcgatttgacttcactgatgaaattggagccggaggaagccgttttgcttgaaaaagaaggaacaagaaccgtggcggcagccgatcttcaggcgggcgacctcattcttgtgaagcctggagaacgcattgcggcagacggagaaatcgaaaccggaaaaacgagtatcgacgaatcggctctaacgggcgaatccatcccagccgaaaaaacactcggagacgcggtttttgcgggtacggtcaatttgagcggatcgctcacggtccgtgtcacaaaggcaaatgaagattcgttgttcaaaaagatcattcggctcgttgagtctgcgcaaaacagcgtttcaccgtcgcaggcgttcattgagcgatttgaaaatatttacgttaaaggggttttgcttgctgtcggactgctgctctttctgccgcattttttgcttggctggagctggagcgagacattttacagagcgatggtgttcatggtcgtcgcttcgccgtgcgcccttgtcgcttcaatcatgcctgccgcgctgtcgctgatatcaaatggcgcaagaaacggcctgcttgtcaaaggcagcgtctttcttgaaaagcttggcaacagcaaaatcgttgcattggataaaacgggaacgattacgaacggaaagcccggcgtggaggatatgcttttagctgcagatatcgaggagcgcgaatgcttggaggctgctgctgcgattgagaagcagtcaggccatccgcttgccaaagcgattgtcgagtatgcagaagcaaaaggcatcaagccggccgcgaatgtgtcgattgaggagacgtcagggtttggcgttcaggctcgatacaatggagagacatggctgatcggcaaagccggatttgtcggggaagaggcagccgggcaatttctcacggcggctgttcaggagcttgccaagcagggaaaaacaattgtgttcatgaaaaaaggcgaaaaaatcgcggggtgttttgcattaaaagaccaaatcagaccggaagcaaaagcggtggtcgaagagctgaacgcgcttggcgttcagacggcgatgctgacaggggaccagcctgaaaccgcagcggccatcgcacgagaagcgggcttgaaaatcgtcgtttcagaatgccttcctgacagaaaagtagaggaagcgaaaaagctgaaaaaaacatacggaacaatcgttatggtgggagacggaatcaatgatgcaccggccctagccgccgctgatgtggggatcgcaatggggggaggaacagatgtcgcactggaaacggctgacgtcgttttaatgaaaaacgaattgacaggactgaccaaaatgattcggctctcccggaaaatgaatacgatcattaaacaaaacgtcattttctcgcttgctgtgatctgtcttttaatctgcagcaactttcttcaaattcttgatctgccgctcggtgtcatcgggcatgaaggcagcacgctgcttgtgattttaaacggtctcagactgctgaaatcctaagcaaagaaacggctgcatgctaacggcagccgtttttcacatcagagggcagtttgaggaagaggcggcaataatagaagcgggcggcacccccacaatacataagcggtgagcaagagacgggaaaaactgatacaatggatgtgatgcttttacattttacatgtatggtacggaaactgtctcaaggagtgaacagagcatggaaagaattgaacaaatctcttcctggctgaaagaaaaaaacatatcttcggcttttattcattcaaaagaaaacgtattttatcttaccggcttttatacagaaccgcatgaacggctgatgggcgtttttatttttcaagatgaagagccgttttttgtttgtccgcaaatggaggccggtcaggcgagagcagccggctgggcgtatgagatcatcggatacggggatcatcaaaacccttgggaactcatatcctcagcgcttcaaaagcgaaacggccaatgtttaaaagtggcggttgaaaaagaaacgcttgctctttcgcgcgccgaaatgctgcaggcggtcacaaacggtgcggagcttgtctctgcagaagaaaggctgaaccaaatccgcgtcatcaaagacgaaaaagaaatcagcatcctccgcgaagcggccaagcttgccgattacggggtcgaagcaggagccgccgcattaaaagaggggatagcggaaatcgatgtcgtcgctaaaatcgagtatgagctgaagaaaaaaggagtccaggggatgtcgttttccacaatggtcctttttggagaaaaatcgggacagccgcacggaaaccccggcagccggacgctcaagccgggcgatttcgtcctctttgatttaggtgtaatcattgacggatactgctctgatattacaaggacgctcgtgtatcaaaatgtgagcgaaaaacaaaaagaaatatataatacggtgcttcaagccgaaacggaggcgcttaagatgagcaaacccggtgtgagaatcggcgatcttgatttaaaagcgcgcggcatcatcgaaaaagcgggctacggcgattactttccgcaccgcctcgggcacgggctcgggatttcgcctcatgaatacccgtccatgagccataataatgacgaacttttgaaacaaggcatggtatacacgattgaacccggcatctatgtgccggaaatcggaggcgttcgcatcgaggatgatgtacttgttacagccgatggagcagaagcgctgacaaagtatccaaaagagctgactgtcatttcataaaaaaatggaacccgccgtgcgcgggttctattttattacggaagtgaatcttttcatctcaccgtcaatcctttgaaatgaagaaatcgtcaaaggaacggaatggtttgatttcgtgtttttctttgaggggtttcatcgctgcttttgaagacagcacgataacgatacataataggatcagaatgaagatgcccattttccttctcctttctggaatgtaaacgtgttcagcaccggtgctgtcttcattctaaattatgaaacgctttccatatcaagccctaaatcaataaaagaaacttctgatgccaaagggttctggaatattttggaccatcgcttgagtttattggggctgcatgctgccaaaaaagtcctgtgatgatcgtttgatgaatgaatctatgacgcctttttgcttttgttttggtgatttagtttgatcaaaagataatcggattgcatcattattctcatgtgaaaaatttgtatacttagctcagaagaaaggggggattacacgggaaaaacactgataaattactgttttagacaaaatcttttcatctcgcatccagatatttcagtctccgcaacgattgcggaatcacccccaaaacaaataagcattaaggatttttctaatgatttgaagccatccattacctctgaaaggaagctagaaagagtgaaaaaattagggtttgtactgtttatgtcgatgtttgcttttgtcagtgtagtaccggcagctgaggcgaaagtcattgatcatgacaaagtgcaaggcttcagcgaagtgacccctgtgacggtttcccaaaaagcggccaaacgttttcagccttatttgaaggttgcgagcggctgcgtgccttttccggcagttgacgcacaaggcaacacaagcggaggtctggagcctaccggagcgcccgaaggccactgcagcaaaagcgtgggacaagtgtactcacgatccgcatggtataatggagtttgggcgattatgtatgcatggtattttcctaaagattcacctctgcctttaaaagcattcggccatcgacatgattgggaaggtatcgtcgtatggatcgacaatccggcaaatcaaaatccaaaagtgctttccatcgcttattctcaacacggtaaatttcaaaaaacagcgccaaacaacaatattatggaaggcgatcatccgaagatccgctatgatgctcctcaaccgccgatcaaccacagcctatatgtggacagtgcaaagggcggcacccagcctctcatcgggtgggaagatttgacgcctgccgcaagaaacgcattgaacacaacggatttcggaagcgcaaacgttcctttcaatgatcacaatttcacgaataacctagaaaaagcatggtttagataaaaaatatttcgagtatccggctgattgtgaaatattttcatatcagccgatttttttcgccgccttgtacctcttccgaaatcttcttcgctgttttcttcatatcaatagaatcccgaaaaaatggccaaaaggatcaaaatctacggctcaaagcgatataatttctttatgatgaaatgatccggatgtgcgaaaagatttgaatgaaagaagggaaacgaatggcaaatatcagggaaatagctgaagcggcaggggtttccatcaccactgtttcgagggttctcaacggccacccgtatgtcaaagaagaaaagcgtcaaaaagttcttgagacgattgaacgcctcgaatatgcaaggaatatgcatgccgttcatttatccaaaggcttttccaacatgataggcgttgtgctgccgaccatcagccttccttatttcggcgagctgctggaaggaatcgctgaagaagctgcgaaggaaggcgttcacttttcgctttaccaaacaaattatcaattggaaaaagaaatttttgcattggagcagctgaaacaaagacaggtggacggcctgattttctgttcaaaagcgatgtccgatgaagcgcttttggactggcgtgaaaccggcccgttcatcctgtgccaggactcaggcgagcagcactttgcaacggtcagcattccgcataaagaagcattcagacttggattggattttttaattgaaaaagggcacacaaagatcgcgattggtttggcaaggaaaaacggcatgaacagccattttcgcctcaaggcatacaaggaagctttggccgcgatcggggagccttaccgggaagagtgggtatttgagcggtcgctgacaattaccgacgggcaaaaactgttctccgaatggaaagggatggaggagaagccgacggctgtttttgtcgcaaacgaccaagtatcagccggtatttttcttgaagcgcagcggcatcaagtggatattcccggaagcctcgctattttaagctgtgacaaccagccgatcagcgaagtgctcggcatttcaacaattgaaatcaatataaaggaaatggggaagcgcgcgtttcgccttctgcaaaaaagaatcggcggcgccgggccggaaaaactgactgttccttacaagctgatcaaaagggcgactgtgtaatcaaaacatcaatctttttccagacagtgatcaaaattcgacatttttcatcaaaaacgtcaaaataaattgacgcgctttcatgagttttgtacgatatgagagattgatgacaaaaaggagctgaggatcgtgaacagatcctttaccgttgaaaaggtactcaacaacaacgttttaatcgctctccatgatgattacagagaagttgtcttgattggcaaaggaatcggttttggtaaaaaacgcggagatcttatcgaacatgagaactacgaaaaaatgtttatcctggaaaatgataaggaacaatcgcagtataagaagctcctcacttatgtcgatgaaaaaatggttgatatcgccaatgatgtcatctaccatatcgcgcaaaaaatcggccagccgctgaacgaacacattcatgtcgccctgacggaccatatcgcatttgcagttaagcgtctagaaaagggatttgatatgaaaaatccgtttttgcttgagacggaatcgctttatccgaaggaatacgaagtcgccaaggaagccgtcgatatgattaatgaaaaatccgacattcagctgcctgaaggtgaaatcgggttcatcgcgcttcatatccacagtgcgatgacaaaccgcccgctttctgaagtcaatcagcattcacaactgatctccaggcttgtccaggtcatcgaagattcattccagatgcaagtcaacagggaaagcgtgaactatttgcggctgatcaggcacttgcgctttacgattgacaggataaaacgggacgagccgattcaggaaccggaaaaattaatgttgttgttgaaaacggaatatccgctgtgttacaatactgcttggaagatgatcaagatcttgcagcaagcgctcaagaaaccggttcatgaggcagaagccgtttatttgacattgcatttgtaccgtttgactaataaaatttcataacgcctttataacgtgttactgattcgatcaggcatgagtgaaaaaaggggagaaatgaagacgctgtcttttgtttcttagtgtacccgctttcaccatgccttttttgtcgttctaaaggcgaaatgtaaacggtttattcagatgaaaaagcagtcttttgaacgaagttgtcatgaatttttgctgtaaggtcaaactattcttagagggggttaaaaaatgtttaaatcgctatttggcgttctgcaaaaaattggacgagcgctgatgctccctgttgccatcctgccggctgcagggattctgctcgcgcttggtaatgccatgcaaaatccgcagatgacaaaagtcgcaccattcttaacgaacagcaccgttcagcttgttgcgaaagtgatggaaagttcaggtgacgttgtgttcaccaacttggcgctccttttcgctgtcggggttgccatcggtttggctaacggcgacggcgttgccggaatcgctgctattatcggatatcttgttatgaatgtcacgatgagtgcagtgctccttcaaaacggttcaattccaagcgatgcagttgaaagagcacagttctttactcaaaaccatccggaatacacgacaatgctcgggataccgacattggcaacgggagtattcgggggtattattgtcggtgtcctggccgcagccatgtacaatcgattctacacaatcgagcttccgcaatatttaggattctttgccggaaagcgctttgttccgattattacatctatttgtgcattgctgctgggacttgttatgctgtttatctggccgccaattcaaggcgcactgaacagcttttcaacgaacctgcttgcagccaatgaagcggtcgcagctctcatcttcggaatgattgagcgggctctgattccgttcggtctgcaccatattttctactcgccgttctggtatgagttcttcagctatacgaaccaggcgggagaaattgtccgcggtgaccaaagaattttcatggcgcaaatcaaagacggcgtcgaattgacagcgggtacatttatgaccggtaagtatccgttcatgatgttcggtcttcctgcggcagcgcttgccatttatcatgaagcaaaaccgcagaacaaaaagcttgttgccggtattatggggtcagcagccttaacatcattcttaacagggatcactgagccgatcgaattctcattcctgttcgtcgcaccgattctgtttgcgattcactgtgtgtttgccggcctgtcattcatgatgatggacatcttgaatgttaagatcgggatgacgttctccggcggtttgatcgactacttcctgttcggaattctgccgaaccgtacagcttggtggcttgtcattcctgtcggtttagtcctggctgtcatctactacttcggattcagatttgccatccgcaagttcaacttgaaaacgcctggacgcgaagatgcagctgcagaacccgctgatgaaggcaaagaagcagcaggagatcttccttatcaaattcttgaagcgatgggtgaccaggaaaatatcaagcaccttgacgcttgtatcacaagacttcgcgtaacagtcaacgatcagaagaaagttgacaaagagcgcttgaaaaaactcggcgcttccggcgtgctggaagtcggcaataacatccaagcgatattcggaccaagatccgacaatttaaaatcacaaatgcaagacattatgtcaggccggacgcctcgtcctgaaaaagcgccgaacgctgccgaggaagtggagcagcaaatcgaagaagctatggttgagcctcttcaaaacgaatcaggtgaagaagtattcgtttcaccgcttgcgggtgaacttcatccgattgcagatgttccggaccaagtattctccggaaaaatgatgggtgacggatttgcgattcttcctgcagaaggcacagttgtgtcacctgtaagagggaaagtgctgaacgtgttcccgacaaagcatgcgatcggtctgcagtctgacggcggcagagaaattctgatccactttggaatcgacacagtcagtctgaaaggagaaggcttcacttcatttgtttctgaaggtgacagggttgagcctggccagaaactgcttgaagtcgacattgaaaaagtgaaggacaatgtaccttccctgatgacgccgatcgtgttcacgaaccttcaagaaggagaaagcgtgagcttgcaggcagaaggcaatgtcagcctgacacaggacgacatcgtccgcatcgaagaataaattcacaaaatggccgtacttgtcagatgacatgtacggctgtatgatataatattgtgaatgtactcaaagctttaaattaaaaggagattgataaaaaatggcacaaaaaacgtttaaagtaactgcagattctggaatccacgctcgtccagcgactgttcttgtacaaacagcaagcaaatatgatgcagatattaatttggaatataacggaaaaacagtaaaccttaaatctattatgggcgttatgtcactaggtattgccaaaggtgctgaaatcacgatttctgcttccggcgctgatgaaaatgatgctctttccgcacttgaagaaacaatgaaaagcgaaggtttaggcgaataatgcttgaattaaaaggaataggcgcttcagccggtattgcgattgcaaaagcatatcggcttgaggagcctgatctaacggttgaaaagaaaaacatctctgattctgatgcggaagtaaatcgttttgaagacgccatcgagcgttctaagaaagagcttgaaaccattaaaaaccatgctttgaaagagcttggcgaagataaagcggaaatcttttctgcacatttgttagtattaagcgatcctgaactgttaaacccgattaaagacaaaatcaaatctgattctgtcaatgcggaattcgctttaaaagaaacggccgacatgttcgtcaccatgttcgagtcgatggacaatgaatatatgaaagaacgcgccgcggacatccgcgatgtcaccaagcgtgtcacagggcatcttctcggcgttgagattccgaatccgagcctgatttccgaagaagtcatcatcgtggccgaagacttgacaccgtctgatacagcgcaattaaaccgcaactttgtaaaagggtttacaacagatatcggcggacggacgtcccactctgccatcatggcgcgctcgcttgaaattccggccgttgtcggcacaaaagcggcaacgaaaggcatccaaaacggcgtaacagttatcgttgacggcatcaatggcgatgtcatcgttgatccttcccaggaaacaatcagcgaatacgaagaaaagcatcaagccttcctggcgcaaaaagccgaatgggcaaagcttgtcaacgaaccgactgtaacgagcgacggccatcacgtggaacttgccgctaatatcggtacacctgatgatgtaaaaggcgttttggaaaatggaggagaagcagtcggcctttaccgaactgagttcctttacatgggcagagaccagcttccgacagaagaggagcaatttgatgcctataaaaccgttcttgagcgtatggaaggcaaatccgttgtcgttcgtactcttgatatcggcggagacaaagagcttccatatttagaactgccaaaagaaatgaatcctttcttaggatacagagcgatccgtctttgccttgatgagcaagagattttcagaacgcagcttcgtgcgctgcttcgggcaagtacatatggaaacttaaaaattatgttccctatgatcgcgactgtaaacgaatttaaagcagcgaaagcgattcttttagaagaaaaagaaaagctgaaagctgaaggccaacaagtttccgacgacattgaagtcggtatgatggttgaaatcccttcaacagcggtcatcgctgatcaatttgctaaagaagtcgatttcttcagcatcggaacgaatgacctgattcaatacacgatggctgctgaccggatgaatgagcgggtatcttatctttaccagccatacaatcctgcgattctccgcctgatcacgcttgtcattgaagcggctcataaagaaggaaaatgggtcggcatgtgcggcgaaatggcgggagatgaaattgcgatcccgatcctgctgggtcttggattggacgagttctcaatgagtgcgacgtcaatcctgccggcaagaacgcaaatcagcaagctttctaaaaaagagacagaatcgttcaaagagcaaattctgtctatgagcacaacagaagaggttgtacaattcgtaaaagaaaccttcaacctggcataagcaattgaaaatccggaccggcatcaccaatgcccgtccgggttttttgtttatctgaatgatcccggctgcggcggagataatacatgtgaccaattgttagaaagggggattctgatatgcctaggcagccattcaaactgggagatgaggtgtatgtcatttaccggaatccgcatgcagcgaatgtggcgcatataaaggaagctgaagtcgttgatcatccgcttcacgaaggcgaactggcattgtttatgtatgatacatatcacgcctttgccgaagatgatgccgttttttcttcatatgaagaggcggaacggctttaccgtgaattatttgacgggatatgaagacattaccggtatatcacatcctctaaatgcaaaaagtaatggaaatatgcaaaggatgtgtctgtttccaatggtaaaaccgtttgttccccaactcgtctatattgaaccgagagccctggaatatccgcttggaaaagagctgagggataaattttcaaacatgggacttgagatcagggaaacaacttcacacaaccaggtgaggaatatcccgggggaaggccacctgcaaaaatacagaaatgcgaaatccactttggtgatcggcgtcagaaaaacattgaagttcgattcgtcaaaaccgtccgcagaatacgcgatcccgtttgcaacagggtgtatgggtcactgtcattactgctacctgcaaacgacaatgggcagcaagccgtatatcagaacgtacgtcaatgtggaggaaatacttgagcaggcggatcaatatataaaagaaagggctcccgaagatacgcggtttgaagcttcctgcacatccgatatcgtcggaattgaccatttgacacatacgttaaaacgcgccattgagcatttcggtcaaaccgaccatggtaagctgcgtttcgtgacaaaatttcatcatgtcgaccatttgctcgatgccaagcacaacggaaaaacgcgcttccgcttcagcgtgaatgccgaatatgtcattaaaagctttgaacccggcacatccccgttggataaacggatcgaagccgccgtgaaagtagcggaagcgggctatccgctcggttttatcatcgctccgatttatattcatgacggctggcaggaaggctacagagttctgctggaaaagctcgatcgtgcgctgccgcagcatgcgaggcgcgacatcacctttgaaatgatccagcatagattcacgaagccggcaaagagagtcattgaaaaaaactatccaaagacaaagctcgaactggatgaagaaaaacggcgctataaatggggcagatacgggattggcaaatacatttatcagaaggatgaagaagcagagcttcgcagcgcccttgaatcgtatatcgacaactattttcccgaagcaaaaatcgaatatttcacataacagagctttagttgataaagctctgttttttgttttgaaaacattatgttaaaaaaggatttttccactccattaacaccgcataatcaagcgattcctcatcttcaatgtagccgggaatcacacaaactggagagcgtccgcaatgaagcaggaacgagagcactggatcgcgcttttccccgtccaatacagcttgaacatactgttcgggcgtcatttcttcagccgacttgtgataatggggaatccgtccgccgccaatgagacgcttgagccctttaaagaccgtcagttcatacatggattgcatcagccgcattccgatgccgagttttcgatagtcgggggacacggaaatatcgacgacataaagggagtttccatcgttttgatgtgtgccgatatacccgttgtccgtcacttcatcccagctgtggtgcggatgatgcggatcaaaatcagccatgagcgctgtcatcgaaccgatgatgcggccttcggaaactgcgcaaagcgctccatcgggaaatcgttcaatatgggaatggagctgctcttcattccacagaaggtcttccggaaacggaggcggaaagcattctctttggagagcaatcaaaccgggaatatcttttttgctgtaattgcggatgtccacctgctgataagaagtgccgttatcgacgtaaaactgtttatagatcgccaatcactccttttgctatttcctccattataccgttattttaacaggctatcttaattttgcgaaatttttgccgataaaaagaatatgaaggtgcatgtaaaggagggtttcatttgtttaaaaaactgcatgtcaaaattgccggatttgttgccgtcctgctggttttgacggttatcgtcctacagttctcgacaacacatttgttgaaatcgatgcttgaagatgaggcaaaagaatcaacgtccagcctcctcggttcaattaaaagaaatattgagcttcaattagaacactacgagatttctttgaatcgtataagtgatggagaaatggctcactcattcttaaaagacggggataataaaattataaaaatcgtcaatgatgaattaaaacaattaaaagaaaaaaatgagtatgtcaatttagcttatatcggcacaaaaaagaaggaaatgtttacatttccgaaaacgacctttgatgatgattataatccggctgaaaggccatggtatacgtcagctgcaaaaacacccgacaaagtcgtttggacggaaccttacaaagatgcggtttccggagatatgacagttactgcggcaaaagccatcgtcgtcaataataaagttgaaggcgttgtcagtatagacttgtcattgaattcattgaacaaaattatcgaaaatcaaaagatgccttatgacggctacgcatttattttggaccaaaacgggacaatgctcgcccacccgtcaaaacagggcgacgatatatcgaatgataaaacatatcgggacatcccgtcatcaaaagacggaatcaaagtaggcaaagatactgtgatcgcttatcagactgtcggcggtacgggctggaaagtcggtacgcagttcgacacggcgaagctgatgtgggtcgcgcaggaaatgaacaaaatggtcattatcgtttcaatcattgctctggcagcggcgatcattttaagctatttccttgccaaaacgatcacaggcccgattaagcagctgattgccaaaacaaaagcagtcgctggcggcgatttgacggtccaaacagcagctgcctcaaaagatgaaatcggtatattgacaaaagactttaacaagatggtcgaacatatgaaagaaatgattgtgcaagtcagatcatcgtccggaaaagtatcggatacgaccgatcaattaagcgctgtttcagaagagacggtttctgcgagcgatgaaatcgccaaagcaatcgaagaagtggcgacaggcgcgactgaacaggcggctgaggtcgaaaatgtcaatgaacaatccgaacggctgtctgtcaaaattaaagaaatcgaacatcatgccgacagcatcaagaaactttcgagaacatcagaagaagcaagctatacaggaatcgatgccctcgggcagctgcttgcaaagtcaaatgaagcaaactcggagacaaagaaagtggaacatatgctattccagcttgaagaaaaaacgaaaaacattgaagacgttgttacagccatctcggcgatctctgatcagacaaacctgcttgctctgaacgccagcattgaagcggcccgtgccggagaaagcggacgcggttttgcggtagttgcagaagaggtgagaaagcttgctgaacaatcggcggtttcttcacagcacatcagtgaaacggtcaaacagattcagatggaaacgaaagaagccgtttcagcgatgacagaagcaagcaagatgaatgaagtgcaaaatggaatgattcacgaaacaggtgaagcgctcagcaaaattactgctgaaatgcaggcgctcgtcaactcaattgaccacatttattctgaaatctcggatatgagcggagagcagcaaaaaatgtccgattcgattcagagcatttcagccatttcccagcagtctgccgcggctgcggaagaggtcagcgcttcggccaacgagcagctgacagcgctggaaagcatcgcaaaatcggctgaagcgctgagcgaggccaaccaagaattattaaatgcgatcaataagtttaacgtgtaataaagaggtccctcttgttgaaagagggacttctcctttttcaacattcacaatcccaattttcagaatatacgtgttacactataagaaggaagggagtgatcattgtggacttaaagatgaatggcaaaacagcgcttgtggctgcaagcagcaaaggacttggcaatgcgatcgccaaagccattgcgaaagaaggggcaaatgtcatgctgtccgggagacacgaagcggacttgaaaaaagccgcggaagagctgaacggactcggcggcggcaccgtctcttatcaagtatgcgatcttgcagacgccgacgggatcaaagcgctcgttcaaaagaccgctgacacatttggaacgatcgatatgcttgtcaacaatgtcggaggaccgaagggcggcagcctgcttgatctgacagacgatgactggacctcatcatttgaattgcatctgctcagctatgtccgtttaatccgcgaagcttttccatatctcaaaaaggatgggggacgcatcgttaatatcgcttcatcatcagtcaaacagccgattccgggcttgctgctttccaacacgtttcgaatgggaatcgtcggtctgacaaaatcgattgccgaagagttggccgaacaccgcattttgatcaacacgctcgcccccggaagaatcgcgacggaccgcgtggcagagcttgatcggctgaaagccgagaaaacaggcctttccgagcagcaggtgaaagaaagctatgagaaagaaattccgctcggctcctacggaaaacctgacgactttgcacagtatgcaagctttcttttatcagagtgcaatacatatatgactggacaaacgctgctgatcgacggcggaatggtaaaagcaatttaagggggatgagaccatgaaaaaaacggtcggatttatcggactcggtgtaatgggaaacagcatggcctcgcacattttagccgcgggctatcccgtcagcgcctatacgagaacgaaacacaaagcggacagcctcgtggaaaaaggggcggaatggaaatcatccgtcaaagcactggcgcagtcgtctgatgtgatcatcacaatggtcggctacccaaaagacgttgaagaggtttactttggaagcgaaggcattattgaaaatgccaaaaaaggttcctaccttatcgatatgacgacttccaaaccttcgcttgccaaacaaatcgagactgccgcaaaagagaaaggactttacgctttggatgctccggtttcaggcggggacgtcggcgcgaggaacggcacgctcgctatcatggtcggaggagaacggaaagcttatgatgaatgctacccgctcttttcgatcatgggtgaaaacatccagtatcaggggccggccggaagcggccagcatacgaaaatgtgcaaccagattgcgattgccgcagggatgatcggcgtcgcagaagcgatggcctacgccgaaaaatccggactcgatcccgacaacgtgctgaaaagcattacgaccggcgctgcgggaagctggtcgctctcaaatctagcgcctagaatgctgaaaggcgactttgaaccgggtttttacgtcaaacactttgttaaagacatgggcatcgcgcttgaagaggcggagctgatgggcgagaaaatgccggggctcgagcttgcgaaaagcctttacgacacccttgttgaaaaaggcgaagaaaacagcggcacccaaagtctgtacaagctttggacagaatacaaataacgaaaaaaaccacttgctgcatgcaagtggttttttgctggttcttattttccgatgaactgctgagtccagtagttgccgtccttcacatatccgacaccgatatgcgtgaagttaggattcataatgttttttctgtggccttcactgttcatccaagctttgacgacttcttgaggcgttttttggccttttgcgatgttttctccggcagtgcggtatgtgatgccgaatttcttcatcatgtcaaatggagaaccgtaagtcgggctgttgtgatcaaaatagttgttatctttcatatcttgagatttcgtgcgggcaaccttgctcagcttttcatccaatgtaagaggttttagcccttgtttctttctttctgcattcgtcagttcaacaacttctttttcatacgcgcttacagaagaagatgcaggcgctgtattttgcttttgctgtgaagtctgctcttttgaagccgcaggctttgaagctttaggagcagaagccttcggtgcagaagctttaggctgttgagttgcttgtttcatataagaatgaagcagggactgaattttttcttggtcagctttagaaagctggttcatgttttggatattcagtttgcccgcgagatcagttacatttatggaatgaacggttttgacttgtacttgctgctgctctttagcgtctgcgtgctgaacgccgctgaatgtgaagagcgttgctgcagctgctgctgataaaagaaaagcttttttcataaacagtaatcctcctaaatgttgtagtagttgttgtttcgtacactagaatcataacatggcttttttgaaataatagatccatatattccctttgacaaggtattattgttaattttgacataaaaaaagaaaaaccctttgctgccaatatgcaaccagatcgttcttttacacgtcttgtcataaacgtggtaaaatttaaatttgttagttaaattttaatataaaaagagattgacagcttttttgaaaactttagattgtaacaaccattacaaaagtgttacaatatatctcagttaattaatgtaaaattgaatattgtgagaggagagagagtttcagtgacagaatctcaacatgatccggctgaaatcaaaaagagcaggcgttcgcgtttatggcggatcaacctgtacttctttgcggtgttcactttgttcgctgcgctgattgtcaagctgggcctcgtgcaaatcgtcaatggagaggcgtatgagcaggaagcttcgaaaaccgaggcgaaaattgcgtcatacccggcaccgcggggtaaaatgtatgacagatacgggcgggtggttgtcgacaaccaaagcgttcccgcgatcacatatacgatgatgactagcacaaaaacggaggaaaaaatcagcacagccaaaaaactcgcagaattgatcgatatcgatacttcgtttctgaaagagagagatctgaaagattactggcttgccagacacccgaaaaaagctgctgcacttctgaaagacagcgagaaaaccctcaagtctgatcaaacatacaagcttcaggtggaccgcgttccggcggaagagatcaaagcgctggaaaaggacaaagatgagcttaaagtcgcagcgattttcagaagattttctggcggctatgcgtatgagccgcaaatcgtcaaggcgatgagcccgaaaaccgcggggaaaaacgatgcgcagctccttgatgagaaggcttctaaacagatgccggccaacgatttgacgtatgaggaagtctcacgcgtttccgagcatcttgaggaactgcccggcgtcgacgtcatcatggactggaccaggaaatatccttatgaaaaaacgctctactccattttcggaggcgtcacaacgcctgaacaagggcttatcaaggaccgggaagacttttacctgacaaggggatatgcccggaatgacagagtgggaaaaagctatctcgagtatcaatatgaagaatatttaaatccgaaaaaagcgaaagtccaatataccgaaaaccgttcaggaaaggttatcagccaggaaacggttgatgaaggaagacgcggctacgatctgcagctgacgttcgacatggagctccaaaagaaagtcgaagaggctatcgaagaggagcttaataaattccgcggctcaaactacatgctggacagagcgttcgtcgtcatgatggacccgaataacggagacattctgtccatggccggaaagcggatcgtcgacggcaaaatcaccgactatgcaatcggcgcgtttacaacccagtacgaaatgggatcggcggtcaaaggcgcgaccgtgcttgccggctatcaggacggcatgccgcatgggcagagttatttagaccaagagctgagcttcgcagggggagttaaaaaaggttcctacagaggaaacactatcggttgggctaatgaagttagagcgctggaaaaaagttcaaacgtttatatgttctatgtggcaatgagaatggcaggaattacgtatgtaccgaacggcccgcttccggcgaacctagaggacttaaagaaaatgaggtattacttcaatcaatttggccttggggtaaaaacaggcatcgacttgccgcaggagtcggccgggatgcagacaaacccaaaaatagtcgggggtctcctcctcgatgaagcgatcggccagtttgacacgtacacgcctttgcagctcgcccaatatgtttcaacgatcgccaacggcggatacaggttgcagccgagagtcgtgaaaagcattcaccagccagaaagcgaaaaactcggtccggtcattgaagagcgctctgccaatgtgctgaatcgtatcaacaattctcaaagcgacatcgccatcgtcaagcaaggatttaaacgagtaacccagacgggaactgcagccggcgcattcggttcgcttgacgtatcaggcaaaaccggaacggcgcagacgcaatactacggcacaaaccgaaactggtgggggactaggacttacaatatcacctttgccggctattacccgtcggaaaatccgcaggtcgccttcagcgttgtcgtcccgaatgtcgacgacaaaacgaagatgaacaaaaacatcgccgccaaaatcgtcaaagcctatgtcgatctgcaaaaaaaatacagcaaagattagacaaaaaagaacacggattttttccgggttctttttttgttatcaaaatttgacgaatgctagaagttttgaaggagatttctcgcattttagcgaatccttttaagcaaaatagttttaatgaatgctggtcatgaatagggtataaaggagggatatgatggaacaaaaaacaaaacgttttgagcaatataagcctcatatgaatttacaggcagtcctgtcagctaacggccgttttatatacatatctgcaaattgcaaagagctcttaagctacgagcagaatgaactgatcggtacgtatttgaaggactatttacacgaagacgatctttttctggtagaaagctatttttacaatgagcatcatttgctgccctgcaccttcagatttgtgaaaaaagactacacgatgatctggatcgaagcatcgatcgatttcgtgacgacccatgttggagaaaaagaacgcgaaattgtactcaaaatgaaagtgtttgaagaccgtccctctaagaaaagcagctccataaaagaggaagacgctccggaagaagcctccaggctgccggcaaaagaggaattcgaagccatgatcgaaggcttgccaaaccctctgtgcatcagcgttcaaggggaaatagtctacgtaaatgacgccatggtcaacctgctcggagccgagcataaacggcaaattatcggaaagtattcctacgattttatcgagaaagagtaccatgacatcgtcaaaaaccgcattaagcggatgcagcagggacttgatgtcggaatgatcgagcaaacgtggcataagctcgacggcacgcagattcacctcgaagtcaaggcggcgccgaccatttatcaaaaccagaaagcggagctgcttcttctcattgacatttcatcgagaaaaaaatttcagaccattttgcaaaaaagcagggagcgatatcagctcttgattcaaaactcaatcgatacgatagccgtgattcataaaggaagatgggtctttatgaatgaatcgggcattcgtctgtttgaagcaaagacgtatgaggatttaatcggcaaagatatttacgaacacctgcacccatgcgatcacgaagatgtcaaagcgaggctgaaacggatcacagaccgccaatccgaatctgaaatcataaaacagacgtggtatacatttgaaaaaaggctcatctatacagaaatggtttgcatccctacgacatttttcggggaaacggcggttcaggtgattttaagggacatttctgaacgcaagcagaccgaagagctgatggtccgttcggaaaagctgtcgattgccggacagcttgcagccgggatcgcccatgaaatccgcaatccgctcaccgcgatcaaagggtttttgcagctgatgaagccgacaatggaagaaaatgaacattattttaatattatcttttccgagttaagcagaatcgaattgatcttgagcgagcttctcatgctggcaaagccgcagcaaaacgcattgaaagaaaagcttgatctgatcaggctgatccgcgaagtgacggcgcttttagaaacgcaggccaacttaaacggcattttgatcaatacgatcctcacagacgacaaaatttacattaaaggggatcaaaatcaattaaagcaagtgtttatcaacctaatcaaaaacgccgtcgaatccatgccaaacggcgggacggttcatttgacggtcagagaaaccgacgattcggtcgtcgtcgaggtggaggacgaaggagaagggatacctgaacatgtcctgaagcggatcggcgagccgtttttgacgacgaaggaaaaaggaacaggcctcggtttgatggtcaccttcaatatcatcgaaaatcacaacggaaccatcgaagtcgacagcaaagcagaaaaaggcacgacatttaagattctatttccaaaataaaataaaaaaacaacggcgtaaaagccgttgtttacgtagtctgtatcgattgcctcttattgaaaacaaaggactccagccggtcaagaccttcccttagcgtatcaggagaatatgcgtaagagatcctcacatagccttccccgtattcagaaaacgagctgcccggcacgatcgcaagcccctcttcttcaagaagcgacatgcagaagtcaaaggaagacattccaaacgatttgatggacgggaaaatgtagaatgctcccgacggtttaatcacatcgaggcccatcgtcacaagtctgtcgtacacgtagtccagccgttttttatactgctcgcgcatgatcagagcgtcatcaaacccgttggtgacggcttccagagcagctttttgagaaatcgatgaagcgcaagatacgttgtattgatggacttttaaaatatgctttgcgatttccttcggtgcgaacaaaaacccgattctccagcccgtcatgctgtgggatttggaaagcccgccgatgacgatcgtctggtcccttagcacagttgcgatcgagtggtgcggtctgtcaaaagtgagttcgctgtatatttcatctgagagcacaaagacgtttcggccttttaaaagggaggcgatgtccttcagctcttcttcggacagcgtcattcccgtcggattcgacggatatggaagaacaacacattttgtcttcggcgtcagcgcttcctcgatcaattttgctgtcagcttaaagccgtgggacgtggtgtcaatgatcaatggagacgctccgcacattttgatgatcggctcatagccggggtataccggccccggaagaatgacttcatcgcccggagataaaatcgtgcggaatgccgaatcgatagcctggctggcgcctgttgtcacaataatctcgctttccgcttcataatttaaatcggcttttttcttcatataaagctgtacagcctgcctcagctcaggatatccggcgttgtgagtgtaggatgtttgattctcatctatcgcttttttggcggcctgtttgacatggtggggggtgaagaaatcaggctggccgattgttaaagagattacgttttcgtactgggatacaaggtttgagaacttgcggatccctgagatttcgatttcttttacatttggattaagcaaatgttccatttagcatcaccttaaaaatgttatggtttatcttattttaccatcatcagaccaattgtcatcttttaatcaatcaattttataaaaactcgtaacaagtatatgcgaaacgatgcaaggtatgcggacatgcggacggcggcagatagaaaaataagacaatcaaacgattgccttacgttatgttccgtttagtagccgtaatcggagtcaaaatcttctttccacgaaatatatatttgttcttcactgtctgaagcttccttgagcatttctgtgtaaacggcccggctgacctcttctaaaatggtcatttcatgatttttaatcgctacaattgttcccatcataaacacctttcctgaaaaatccttgaccattgtaacacgataaatgtcaaagtcaatgaaaaacttgtgatccgtacattaatttaactttaaaaaaatgcgatacgtattgataatgttcagccagtcttagtagtatatagaagtcaagatgttaggaggaaaagcacattggaattggaattagacaaacacgaaactgctcctgaaaggagcgagtatgccggaatcggcgcgcgttttgtagcttccctgctcgacggattgattctcgggattcccgcatatattttcacgtacgttttaacagcgacgttgatgttgggaaattcggatatcatgctcatgatggagactgatcccgagtatttgagcgatcaggaagtctttacgtttatcatcagtatgttcaaaaccgtagcgatcgttggaagtattacttttattgtgtattttctttattacacgctgatggaatcatccaaatggcaagggacgctaggcaagaaaatcatgaacgttcaggtggcgaaggcagaaggcggaagaatctcattcggccgtgcagccggaaggtttctggccaaaagctttctatctccgattttgatgatcggctacattatggccttttttacagaaaggcgccaggcgcttcatgatatgttggcaggaaccattgtcgtaaaaaaataacgggcaaaagacagcacgctttcagcttgaatgcgtgctgtcttgttcaggaaaatgtttcacggcaggaataaaaataaggaggcatcaatccagatggatactcagccggaacgtgaacaagctgtaaagcgggcgcaaagaacgggaatcaagctctttttgacgctgccgattctttcttgggcgttatacgattttgcaaataccattttttcatcaaatattgtgacgatcttttttcctttttatttgcaggaggcagtcggcgaaaatgccagcatgaatcaggtggcaagcacttttatctcctattcgaacgcagccgcaagctttctgcttgtcattttcacgcctttattcggagtgctgatcgaccgaacgggcagaaagaaaaaatacatcggcctgtttacgatgatttgtgtttcatgcaccattttaatgggggtttttgccggggcttcgtttcagaaggacatatacgggcttccgctatccttgatccttgtcgtcatcatgtttgtgaccgcaaagtttttctatcattcaagcttggtgttctatgatacgattttggctgacttggggacaaaagaagaaatcccgctcttatcaggtttcggaattgcaatcgggtatatcggcactttagccgggttaacggtataccttcttgtcggcaaccaggattttcaccgcgcattcatcccgtcggctctcttgtttctgtttttttcacttccgtatctgctcttcacgaaagagaaaagaaaaccggaaccgaaagaaaagaaatcgtttttcagcggatactgggaaattgtgcagacattcaaagacattcgtctatataagccggtcttcttattcatgatcgcctactttttcctgaatgatgcgcttgctacagcaatagccatgatggcggtttattcaaaaacggtcatcggttttacgaccggacaattcgttttgctttaccttgtttctactgtatcaagcatcatcggttcatttctgctcggctttgtgacgaaaagaatcggcgccaagcacgcggtcagccttgtcgccgccattatgatcaccgctttgacgattggagcatgcacgacgtcaacgctcttgttttggattgcggggagcttgttcggcatttcgcttggaggcacatgggtcgcatcaaggacactgattatcgagctgacgccagaacataaaagaggcgaatttttcggattgtttgctttgtcggggaaaatctcttccattttcggtccggtcctctacggatcgattactttgctgttcagggatctcgggaacatggccagccgaatggctttcggatctttagtgttattggcggcgatcggcctgatcattcatcaaaatgttaaggcaaaagcttgagccggagcatcaacttttaacaaaagacgccgatataaaaagtaaacacaaagtaggatagagagggatatcagtgtcttcaaaccaacaggaaattttattaagttcgggaaccaatgaattagaaatcgtgaagttcgaggttggtctcaacattttcggcataaatgtcatgaaagtcagagaaatcattcagccggttgaaattacgaaagtgcctcattcgcataagcatatggagggcatgattacattgcgcggggaaattcttcccgtcattgatttattctctttctttggcgttgagcacggtgatgacgagcatcaagaaaaatacattgtgacggaatttaacaagcggaaaatcgtctttcacactggagcggtttcacagattcaccgggtgtcatgggaagaaattgagaagccgactgctttgaatcaagggatggaccgtcaccttaccggcatcattaagctcgacggcaccatgattttcctgccagattacgaaaaaatcatttttgatcttgagtctgagtcaggtatggacccttatcaaatgaaaaatgaaaaattcgatcagagacggactgacaaaaagctgatcattgtcgaggactctccgctcctcttgcggctattggtggaaaagctgaatgaagcgggatacaacaacatcgtgtcttttgaaaacggaaaagacgcttacgagcacgcgcttcaattgatggaagacggcacagctcttcacgaaaaagtcgatctgatgatcacggatattgaaatgccgcagatggatggacaccggctcacaaagctgctaaaagataacccgctgagtacggagctgccgatcttgattttctcttctttgattacagacgatcttcgccataaaggggaacaagtcggagccgatgaacaaatcagcaagccagagctcaatgaactgatcgaaaagcttgataaatatattttcaagaactaaaaaaagcctcgaaaggaggcttttttttttttattaaaaatagctttcgccaagcttcttgaagacgggttttgaggctggacgcttccggtttgtgacgagcggtttttctttgattcccgtgtagttttgaagaagctgtttcgctatattcaaggacatatgagctttagggttccgatacgaatgatttaatgtacctaagtgtggaaggtttgcgaagtcttcttttgttggaggcatgtgaaaaaagtagtctccgagagatatcagcacatctgactgctgctggctgaatcttggatttttcgaaaaatgcaggcctacctttttaccttttccttcattaagcagcttttgcaaagctttctttttcagaagatacaggtatttgggattagtcgcggttttcgcatggcggttaactgtataaatcgcttttgaaaggttttcaactgtcggttttaattctttcgtatgattatggtcgtccattttttctctcctatccattcgtttctagatcacctcctaaagatgcaaggcttatgtctaaattatacgaaatagaacagaaaatgcaaatatcccatagaaaaaacgcgcgattttttatggaatcgcgcgttttcatctttataaaacagagttcattttcgcttttgtatttttttgtctcttcagcgccgcttgaacgtcgatttccgcactctcggcgcttaatttaggcagggcgataaagtagtacagcgccgccagcagaataattcccgccaagccgtaatatatataatccacatcggcgatgattcccgggaataggacagcgatcatgccaagcgctgaggattgcgccagcattgtcagcggatcggtccacccgctgacccttcccatcagccttggatggacgattttgggaatccagccgccaagagctgtgttgatcggcccgatgcatatcccggcaagaaatgcagccgagtagtatacgggcaattgatctgtaaagccaagcaggatgataaaggcacccgcgataaaaatcgggactgacatcatgtatgccggcttcacttttttttcgagcagggcggcgacggcaatcccagtcaaaagtccgatgcccagtacgattgtgaagagggaagtatgccactcataactgtcaggggacagctcatacttcattttaaacatcggcagaaccgaaagtccgccgcttacaagcccgaaaataaaatatccgaatacaagagaggcaagcaatttattttttaatatataaacgatgccttccttaaaatcgcgcatcgaatctttgacggtcatgtttttccagcctttatttccgttcggcttccgcgctgcaagcggtatatcgcaggaacggattaaaaagccggagacgataaagctcacaaaatcaagagcgattgctccatgcaagccgatcgtcttgtacataaatgctccaattcctacgccgaacaatagaaacaggctgaaaagcatctggttcagtcctgcagcctttgcatactggtcctttcttaaaatggcctggaccaaacttgcttcggccgggtagaaaaattttgtaaccgcgcttctgataaataggactaaaaacacaagcggtataatttgaagatacaatacaaagaaaagaacgacagtcagtcccgctctgatccaatcacagttttccgcgactttcttgcggtcaaaacggtcagcgaccaccccgacgataaagaatacgaaaaccgtcggcaaggaatacatcagctcggcgattgtcgtataggccggctggctgctgaaccggtcgagcaagaaaaaggcgaaagccatatttccgactgtcgttcccatttgagaagcgaaagctgcgaaaaaaagtcggacgaaattacgatttttaaaaagatccatatatacgctccttaccctaaaggtcccattatatcttaatacaagatgttgtattgttcaaattgcatttgtctggaaatgtactcgtctaaggtgtaatggacactcgggttccgttgggtacgatagaagcaagttccagaacatcccgattgtgcatgcggatacatccccttgaaacagctttgccaattgacgaagggttattcgttccatggatgccgtagtgctgttttgacaggctcagccagtaggcgccgaacgggccgcccggatttggctgccggttgacgatgacaaattcgcctctcggcgtctgtgtgaggatttttccgacggcaatcggatatgtttttacaagtctgtctcgctcatacaatctgagcgttcttccgttgagagacacggcaatccggtatggaattgtgtccggatttctgatgccgggaatgataatcgactggcccgcggacacttggccgccgtttaagccaggattcgcctgcagcaacgcctgccgggtcgttctgaaatcggcggcgatgctttcaagggtttctccgggtttgacttggtacatcagcaataatcagcacatctccttttcaaaaacgaaaagagagccttttccgctgctaatatatagacggaaagaggctgaggaagtttcgtttttttgatggggattggatgaaatggagcgggaatgtttttacttaatgtatgcagatgccttttgttttgagccaaaagaccgggcaagatttaaatggattcaagctggaacacggtgatttcaggctttgacagaaagcggagcggcagcctggtcgtgccgattcctcgattgacatagattttcattccggctgtttcatacattccttccgtataaatttctccgtacggaggcgtaatcaaaggaccgaatacgggaatctgaatttgtccgccgtgggtgtgtccggatatttgcagattgacggggtattgatttgccgttaaagcggcatcaggctcatggacgagcaaaatcgaaaaggcttttttgctcagctttgacaggatgccttcgtagtcaggtctgccgagcatcaaatcatcgagtgaagcgatctcaattacgcttccgtctatcaattcaagcttcagcaaatcgtttcgcagcacccgaaaaccggccgatgccatgagcgtctgatagacttttgttccatagcctccgtgatcatggttcccgaatatagcaagctttccatagggggctgaaagcttttttaaggcgcttacagcacgctcgtgttcccggtagcgatgcggtttatctattaaatccccgctgaatacgataagatccggggagagggcgttcacttggctgacaacatttgaaagctcgtctgctgtaaagtattcgcttaagtgggtatcgctgaactgaacgatccgaaactgatcaaaccctttaggaatgagccgatgccgaatgggaataaagtttgtttcaagcatgtgcggttcgagatagcgcgcatagcccaagccgccggcagcggtaaagagccctgctgcggcaaggcctaagaagccttttaaaaattgtcttctggacggatttttcataatcaaccaacctttaatagattctctacattatatcatccagaaaagccattttaggacagtccgcatgttttgttaattttttttaatttatatgataaactatcaattgaatgaatactcattcataacaagggggatggatatggacagaaaagttgtaatcgtgaccggcgggtcgagcggaatgggaaaagcgatcgccaaaaagcaggctgaagaaggatggaatgtgatgattacgggcagaacacaagaaacgctcgaagcggccaaagaagaaattgaaacttttgccgggcaggtggccgtatgccggatggatgtccggtctgttgaagatgtggaacagatgatcacagaggcggcaggacggtttggcacgatcgacgctttggttaacaatgccgcaggcaactttatctgcccggctgaaaaactatcggtcaacggctggaaggcggtcatcgatatcgtgctgaacggcacattttattgcagccaagcagccggccgctactggatcaaggaaaagaaacgcggccagattttaaatatggtcgcgacgtatgcatggggcgccggtgccggtgtcgttcactccgcggcggcaaaagcaggcgttctgtcgctgacaaggacgcttgccgtcgagtggggaagtgcatacgggattaggtgcaacgccattgcgcccggtccgatcgagaggacgggcggagccgaaaaattatttgaatcggaagaagccgcgcacgcgacaatcaaaagcgttccgctcaaaaggctgggcacccctgaagaaatcgcgggactcgccgcatttttgctttctgagcaggcgggatatgtcaacggggagtgtgtgacgatggacggaggtcaatggctgaatccccgtccgttttagatttcaaattcaaaggtgcgagccggtatggtataatcagacaaagattagaagcaggtgatatgccatgttggatccactcgatattttaacgaacattgaagatgtcattccatactatcagccgatcttcagtgctgaagaacaaaaggtgatcggctatgaagtgctggggcgcatcaaggtagaaactgaagtgaagagcctcgggccgtttttttctgatccgacaattccggaagaatacaagaaagaggttgatctcaaggtgatccgccaggcgctcgatcattttctggacagcgggcgcgacctgctcatcttcgtcaatcaagatgcaaatgtgctgatgatggatcacggcgaatcgttcctcgacctgttgatggaatatcaggataaagggctcgagctcagccgtttcgttatcgaaatcacggagcaaaagtttgaaggggatattgaacagcttcatcatttgctgacctattaccgtacatacggaattaaagtcgctgttgataatatcggtaaggaaagcagcaatctcgacagaatcgctcttctttctccggatctgttaaagatcgaccttcagccgctcaagctgtcttctccttcgccttcctatgaatatgtgctttacagcatatctctccttgccagaaaaatcggagccgcattgctttatgaagatattgaagcgagctttcagctgcaatacgcatggagaaacgggggccgatatttccaggggcagtatcttgagctgccgaaggataaatttatcgaacgggatgtattaaaggaccggctgcaggccgagtttcatcaattcatcacgcatgagaagaagaagctaaccattctgtacgatcactccgagcagttttacaaacgggttcatcagcttgtcacatcgctaaagaaaacggctcagtcagacgatgaatttctcttcaatctcggaaaagaactgacagattgcagctttagaatttacatgtgcgatgaagacggtattcagctgacgaaaaacgtgtttaagcatgacggagcatggatatttcagcctgagtacatcggcaaaaattggagctggcgcccttattttctcgagaatatcatgaggatgagaacgatgagaaaagggtttttcagcgatttgtacagcgatatcgaaacgggggaaatgatcagaacgttttcctatccgatggatgaagaattgtatctgttcattgacctgtcctactcatatttatacgaacaagacggattaatttaagcggcggcctttcgccgctttttctttttgaaaaaatgaatcccgagaggtttgtttcgcgtatataaaggaaaatgtgaaaatataaatgctaaaaaggggtggatcatatgaagaacgtttggtcatccttactgtgcgcgcttctggctgcggctcttgtattcttctgcgcggattttgccaaagccggagaaaaaccgacaagagcatcgttatttgagacccttcaatccgtatcggacgtccattttcagctgaccgaaaaggaaagaacgaaaacagacatgatatccctcttggaaccttatatggagcacgccatggcagtgaagtatgtagaggcgaacgcctttcctgaacaagcggggtggattttttacgggacagacgcgcctgaagttgcaatccctttcttcagctatgacgaagacacaaaagtggcggagaaagacggaagctataccgtatatgaatttgttggagatcaaaacgacggccctgtttcatatcaaaaaaattatcagacggtgacgctgaagaataccggcggcagcttcaaagtaacggatatcggccaatctgatacaaaaccggctggagaagaaataatgtccaaacaaccggatgaaaaagaaacaagctcgaattttgcggataaaggggaaggagaccaggctgcatttccgctttttgccaccgatgttaactggacattggccggaattttcagctagcaaaagaatttaaagaaaatcattgacaatgatactgataatcattatcatttaattatagagagatgaacctctctgttccccaacccctctatcagatcaagatttaaaaaacttggcgctgcccccgccaagttttttatttgcatggaatcccgcacttcaaatagctgcgggatttttgggcattaggcgcgcgcaggaataagacaatcctttgctccataaatctaaattggtggttcaaatagactcctctgcagtcaaaaaaatatttttcatgtatgacatgaaaaaagaaaactcaaactatgaaaaagcggtttttctttttcatgatcaaaaaggaaaaatgtcatcggctgatactttgtggtatgatgctttgtagaacttgtattataattaatacttgttgatcctgaagttgtttttttgaaaggagtcttttttagaatgtcacaattaatgggtatcatcacgagactgcagagcctgcaagagactgcggaggctgccggagaaccgacgcagcgcaattttgaagtgaacggagaaaaaatttgcagcgtaaaatattttgaaaaaaaccaaacgtttgagctgacagtttatcaaaaaggagataagcctaccacatttccgtttgacaacatcgatatgatttcaatcgaaatctttgaactgcttcagcaataggaggatatggcatgaaagcttttccaagcgttatttgtccgcattgcaaaacaaccgagcatatggatcaagttctgacggcccagtccaatcagaatgtgatttacagatgtgagagctgcgggttcagcttgaaaaatataccgaccaaaaaaggatagcagacagacgaatcgttccatcttcggtgcagatcaaaaatgaaaaggggcattccaatggctgattcttttcttttttacaatctttctgaagatcaaatgacatttcctgaagtgatcgggagactaaagtcgttcatacgccaagatccgagggcaagctatctgctgtccgtcggaacagactcgcagatccatcagaattgcacaaaatttatcacagctatccatttgcaccgcaaaggcaaaggagcgtggggctgtctgaaaaacacggttgtcaacagaccgatacatagcctcagggagaaaatatcgcttgaaacagcttacagccaagagattgccgcatatcttttaaatgattattttaatgaaatcatggatctgcttcttccgtttacagacgagggagcagatttaacccttgaagttcatttggatatcggaaaaaaaggaatgacaaaggatttaattcaggaaatgacaggacgaatcacttcgatggggatctgcgccaaaattaaacctgactcctatacagcttcaagctatgcaaaccggtacacaaaataattgtttgaaagaaaatcgaacagatgtcgaaatgtgcggttgacgtttgattttcaatttcatattctagccctatagaaactagagagaacatattgtttctgactctagctaaatcaattagggggctggttaagaatggaacgcttttcagaagaagagagaaaactgttgctgaacgtacttttggaccatgagtatgccgtagagctactaagcagtgagatcaatgatatagaaactggtacaaaaaatgtggatagcctgacatataagaaactggttaccttatatgaccgtgtccggtctgaaaattaggtcagattatatcaattgatactcattagagtatcttttttgtttcctaaaaggatattgaatgataaactgaccttgggagaaaggaaagttttcgacaaatattgatattgtttatattattgtagtatagggaaattatgcgttgatggattaaagctgaaaaggagtcgaaaaatcatgattagtttgcaatcagatgaacttcttgaaacgacagtaggtcagtttatgatcgatgctgataaagtagcccatgttcaagtcggaaacaatctggaacatgcccttctcgttttgacgaaaaccggatataccgcgatccctgtacttgatgcttctttccgtttgcacggattaatcggaacgaatatgatcatggataaaatcttcggcttggaacgaatcgaatttgagaagcttgataagattcatgttgaagaagtcatgctgacggacatcccccgcttaaaaattgatgatccgattttaaaaggattcggactcgtcatcaacaacgcgtttgtatgtgtcgaaaatgaagagcaggttttcgaaggcatttttacaaggcgtgtcgtattaaaacagctgaataagcatttgaggacgttgaataaataggcgcggcagcggcctattttttatttgcagcgctccatccaatcctccgcacattccccgatgcccgacttcccgcttgattaaaaaacagccgtttgattaaatgtatgataagaaaaacttattggaatgaggaatgtccatgcagcttcaagagcttcacatgcttgtcgttctggcggaagaattaaatatgcggaaagcggctgaacgtctgtttgtttcccagccggcattatcccagcggctgcagaccatcgagaaatcatggggaacgaaaatttttttaagatcgcaaaaagggctgactgtcacgtctgccggagaaaaaattatccagtttgcaaaagatgtaacattggaacaggaaaaagtgagagagaatatagatgagctggagggcgagatacacggtacgctcaaattggcggccgcttcgattatcgggcagcattggcttccgaacgttctgaaaacctacgttaaacaatatccgaacgtcaaaatctccctcgtcaccggctggagcagcgaaatgctgaaaagcctctacgaagaccatgttcatattggcattatcaggggaaacccggaatggaaaggccctaagcactacttgatgcgggacgaattgtacctcgtcgatacagagatccgaaacattgaggacattgccaaaacggaacggccgttcatccagttcaaaagcgacagcacgtactatcaggaaattcagcactggtggcaccaaaagttcaaaacatcgccgaaacaaaccattattgtcgaccaaattgaaacatgcaaacagatggctttccacggaatcggttatgcgatccttccatcggtgacgcttcacggaagcgggagccatgttcaccaaatccctttgcttgatgctaaaggaaaagcaatcggcagagatacgtggctgctcggttatgagccggctttccagctgaagcaagtacaggcgtttgtagaagttgtgaaagaatgtacggcaatggaataaacactagaaaggcaggactccaaaaaggggactgcttttttttgtacgatttattgacattgataatcattatcatttaaagtgtatctatacaataatgaaaatcattatcaattatagaggtgattctgttgtctaaagcattgattgcatatgccagcatgtccggcaacacggaggatatcgctatgatcattaaagatacattgcgagagtacggttttgatgtcaccattcaggaaatggatgatgtcgataccgactcattggctgaatatgatcttcttttaatcggcacctacacatggggggacggggatcttccttatgaagcggaatcgttttacgaagaggtctcttcgcttgaccttaaaggaaagaaagcggcatgcttcggatccggcgattatgcatacccccgattttgcgaagcggtcaacacgttttacaccatgcttgaacgaaccggcgccgacctttatcaagagacactgaaaatagagcttgctcctgaaacagatgaagatgccgagtgctgcaaggaatttgccgaaggctttataagatgggcagaacagcaaaaacggcgggctgagatccatgtttcataaaggtgcgacggccgtcgcttcggcaaagcattccggttactttgtcgccgtcaagcgggaaggcatttttcactattcacttgagcaaggctggaaaaggctctttcaattaaaaagcaaaatttgttccatcacctatatcggcgattatttattcggcgcaggggagagaggaacgattatcagatcgtctgaccaaggggcaacctggtcaatctcaagctttccgacaaacgccacgatttggtcgatcacggggagaacggacggctttgtgtgtgcgcatgggaagcattgcatttacatatccgacgatttcggcgtctcatggaaagtcgtcaagccgttttccggtttgagtcatccgcccgttatccgctctctgtgcctccatgaagagcgcctttacatcgggacgcagattcatgaagtgcacggcggtgtttgggcatacgatttggcatcagaatcggcttttatgatcaaaaaagaaaccggccgcatgaccgcctcgatgatcgcatttgaaggcgaatggctggtatgtgcgatgggatccaaaaaagggaatcacggtgccgtcgatttggtcaacattcacacaaatgatgaaatacaaatcaggcggggccttgttgagaatgaagaatcattcctggatgtgtccgaagacaacggaatcatctatgtcacatcggctcaggaccgagacggcttttcaagaatctatcagcttgatttctttgagagggagctgaaatggtttgacacgataaaagggcatgggttcagggtggccaaccaaaaggagaacttcttttgcgcaggtctttatgaatgcaaatttgtcaggccttatgaacagcctgctgcagcccactgattttatagcgttttataggaggaataatgatggggaaagttttgctggtttatgcaagcatgtctggaaatacagaggcgatggccgatttaatcgagaagggccttcttgagggcggggccgaagtggaccgtcatgaagcgatggatgtagatgcggcgctctttaacgattatcagcacatgatatttggcgcctatacttggggcgacggagaacttccggatgagtttttggatatttacgacgatatggaagggatggatttcacaggcaagacgtttgccgttttcggatccggagatacttcttacgagcatttttgcggtgccgtcgacattcttgaagataaaatcaaggagctcggcgggaacgtggtgcttccgtccgtcaaaatcgaaatgaatccggaggatgaagaagaaggcatgctgctccaattcggcagggattttgcaaagaaatgtgaagtgccggcatagcttttgataaaaaaggaaacgggacatccctttcctttttttcttgtttttaaatctttcctttgatacagtaatgaggagaaaaagagaaggaggacttacataatgaaaatgatggatgcaaatgagattatctcatttattcaaaatagtaagaaatcgacacctgttaaagtgtatgtgaaaggcgaccttgaaggaattgacttcggcgcttcagccaagccttttattacaggcaatacaggggttgtattcggagaatgggcggagattcaagctgcgctcgaagccaacaaaggcaaaattgaagactatgtcatcgaaaacgaccgccgcaattcggcgattccaacgctcgatttaaaaaatattaaagcgcgcatcgagccgggtgcgatcatccgcgatcaagtggaaatcggcgataatgccgtcatcatgatgggggcttccatcaacatcggctctgtgatcggagaaggaacgatgatcgatatgaatgtcgtgctgggcggacgagctaccgtcggcaaaaactgccacatcggagcgggatccgtgcttgcgggtgtcattgagcctccttcagcaaaacctgtcgttattgaagacgatgtcgtcatcggtgcaaacgccgtcgtacttgaaggcgtgactgtcggaaaaggagccgttgttgctgccggcgcgatcgttgtggaagatgttgagccttacacagtagtcgccggaacacctgcgaaaaaaatcaaagacatcgatgaaaaaactaaaggcaaaacagaaatcaaacaggaattgcgccagctttaagaagcggcagcgaaaagtgcgtggatgtgacaatccacgcattttcgcatcgccggggaggttagaaagatgaaattggacgaattagcagcgattcgcagagatctgcaccaaattcctgaactcggttttcaggaatataagacacaggcttatcttttgaaccacttagcaaagcatccggaaggacggattgaaattgaaaagtggagaaccggactgtttgtaaaggttaaagggacggcccctgaaaagattttggcgtacagggcggatatggacgggctctctattcgggaagataccggatattctttttcttccgttcatcaggacaggatgcatgcgtgcgggcatgatttccacatgacgattgccctcggcatcatcgatcatttcgtccgccacccggttaaacaagatctgctgtttttgttccagccggctgaggaaggaccgggcggcgctgagccgatgcttgaaagcgacttgtttaaaaagtgggagccgagcatgatcacagcgctgcacatcgcgcctgaactcccggtcggaacgatcggaacgaaaagcgggctgctctttgccaatacgtcggagctcgtaatcgaacttgaaggaaagggcgggcatgccgcatatccccaccttgcagaagatatggtggtcgcggccagttcgctcgttacgcaaatgcagtcgatcgtagccaggaatgtcgatccgctggacagtgctgtcattaccatcgggacgattacaggcggatcggcacaaaacatcatcgctcaggaagcaaggcttgaagggacgatcaggacgctgtccccagcgtcaatggaacaggtgaagaaaaggatcgaggccatggttcggggcctggaaacggcttatcaatgcagcggtaaagtcagctatcctgcagcatattatcaggtctgcaattcaagcgatttagtcgaagactttatgcagttcgtttctgaaaacggccttgcagaggtcgtccgttcaaaagaagcgatgacaggggaggacttcggctatatgctgaaaaagtatccgggcttcatgttttggctcggcgtcgattcaccttacgggcttcaccacgccaagctgcagccgaaagaggaagcgcttgaaacggcagtccgcgtcatgacggcttatttctcttccaaagccaattagataaagcggctggtataaaaaatcggcaaacgtggcatcttaattggtggaggtgtttcttcatgtcgaaaaaaatcggaatcgaacaatctctttctgatgtcgaggctgctttgaaggaaaaagggtatgaggttgtaacgatgaaaaccgaagacgatgcaaaaggctgcgactgctgcgtcgtcactggtctggacactgatatgctcgggatttcagatacgatgaccggagcatctgtcatacaggcgacgggtttaactgccgatgaaatctgtcagcaggttgagcaaaaacttcagtaatagacataaaaccgaagttccagcttcggttttaacttgttttccaaaaaaaacagctgctgcgtgttaaacggttgtttcctcatccggcggcatgttacaatttttttaaaggatttaaatagaacaaccgctaatttaaatttattatcaattaatattgacttaaaatatggtaagcattataatgaactatgtatgtgatattattaactaaatgagaatttaatatttgaattctcatttagatacgggtagcataacccaaaaatcacaattggagggatacataaaatggcagaacgcatggtaggtaaacaagcgccgcgctttgaaatggaagcggttcttgcaaacaaagaattcggaaaagtaagccttgaagaaaacatgaaaaatgataagtggacggttctattcttctatccaatggacttcactttcgtgtgtccgacagaaattacagcaatgtctgaccgctatgacgagtttgaagaccttgatgcagaagttatcggcgtatcaactgacaccatccacactcacttggcatggattaacacggaccgcaaagataacggtctcggccagctgaaatatccgcttgctgccgacacaaaccatgaagtatctcgtgaatacggcgtactgattgaagaagaaggtgtagcgcttcgcggattgttcatcattaatccagaaggcgaacttcaatatcaaacagtgttccataacaatatcggccgtgatgtagacgaaacattgcgcgtgcttcaagcgctgcaaacaggcggtctttgccctgcaaactggaaaccgggacaagcaaccctttaatttcgataagaaatctgattggaaaggtctaacatttgttagacctttttaaacgacaaaaatgacattggaggaaaaatcatgaaattacgtcagccgatgccggaactgaccggcgcaaaagagtggttaaacggagaagtgacaaaagagcagcttataggagaaaagccgacattaattcatttttggtccatcagctgccacttgtgcaaagaggcgatgccacaggtcaatgaattccgcgaccgctacagcgataaactaaacgtggtggccgtgcatatgccgcgttcagaagacgatttagacttgaataaaatcaaagaagttgccgctgaacatgatatcactcagcctatttttgttgacagcgaccataagctgactgacgcttttgagaatgaatatgtccctgcttattacgtgtttgacaaaacaggccagcttcgccattttcaagctggaggcagcggaatgaaaatgctcgaaaaacgtgtgaaccgcgttcttgccgaaacagaacagtctgctgaataaagatgaaaaaccccgttttcatggggttttttatttatttggctccccaattacaaaaaaacaaaaaaaatttcctctagcctcccctttcgacaaataggccatttgacactgtttatttcatttgatgagtctggtggcctgtttttggttcgggagcatttcttacttaccccgtgcataaaagactgtggattcgacaagtgaaatctggaaattttaaatattctggatttataaggcggaataatcattgatatctcacactttccatcataattaaacagtggattctattcctaaattatgtttcattgaaaagtaattttctaggttccttcattatttaccatttttcgacaatgagcttagaataggccgaaatgcttcaaaaactcctcaggcttcaagtttttcggaaatttagttctattttcttaacggagagcaacagtagaaaaacgaaaaaatagttgataaaattagtttggtaatctaatatttttattggaaggtttatttattctgataggagggtataaacggtatgtttaacgagagggaagcattgcgtttaagattagagcagctgaacgaggctgaagttaaggtgattagggagtatcaaattgagcgggataacatatatgcaaagctgcgtgaattggatcgtccatccagctttaatgatacaaaaaaagattttcgcccggagcgtaaaactgaatctctccctgttttagctgaattggctgcacaggagatgaagagctaccagcaacagcagcaacagcagccgcaagcatctcaaaagaaccagcagcagacttctccgcaaacctcctcactgcctgccggaattccagatggaacgacaaggcgcagaaggggtacagcacgtccaggctcaaaagctgcaaaattgcgtgaagcggcgattaaaacattaaaacgccataatgcggccatcaaaagctccgaacttcaaaaagaaatcgaaaaagagagcggacttgagatccctaatatgacaacctttatgcaaagcctgattaaaatgtacccggaagtcaaaaaaccataccgcggtcaatatatattagagggtgagatttctactgagacagagcagcaataggtcaaacccttgctttttcagatagcgtttccattttaagggaacataaaggcggccgctttatacgccgccgcccaatcaactgcttgagacaatctactcaagcggtttttttgtaaaaaccaaattattccttaaagtggtatttaatttaaaggttttgtttctttgtctttgcgtttaatttgatagacccatttttgcgggggtgtttcttctttcgcctgttttttccattctgttattttttgatccattttcgtatcattttgttgaatggcgctcaattgttgttggagctgatcaacttgctctgtaacagtttgaagcaccgcctcgatctgttctgtccgttcaaaaacctcctcgttttgttcaagcgccttctccgtctgctgaaatgcatcaatatcggcaaaatgagaagcgatccacttatcactttcatcgagttgccttttataagagagaatcgtttcataaaacagcgcttcttttgttttttcagcctccaaaagccggcttttcgtttccgtcacccgctcttttaataccgcaacatcagtttcgatttgtttgagctgaagacttttagcatgaagttcatctttcaggcgggcattttcgtatgcagcgtttttgagctcctgttcctttttttccctcagcgttttttctctttctgcatgaagcttttcgtattctatttggctatgtaagctttttttctcttcttcggcttttacatttgttaaatgaaggcggtgcttttcttctatctcttgttttcttgcataggtttctttttgaagaagctcctgaagaacgacgattttactcagcaattcgctttttatccggttgagcgtttcggccgacttgtcttccttgtttgccgaaatccgctccagttcgaatgacagctgctgaagctgctgtttcattgctgcgttttcccggctgagcttatgatttttctggtgaaaatagcttgcttcaagctcgtgtatcaattgatgtgatcttgccagctcagcttttaaaaaaaggttttcctgtgataaatcttgaaaataaggcagcgaacccgatgtttttttcatggtgaccagccccctataaatgttacaactacaatatgcataaatgaaacccgccatgccttttgaaaaagagattttacagacttgttcggatttctaaagttttgctatgatgttcgcaggcaggaacacgcgaaggaaggttgagccgtatgaaagaaatacatgtcatattatcaggggggctttcgcgccgttttggggaaccgaaggcgtttgcccgctggaaaggcaagccgctttatcaatggtgcaaacaggcgctgggagacgacgtcctgatattgagccgtccgggcttgacggagcggtttatagaactcggggaaaaagcggtgctggaagatatcgaaccgtacagagggaaagggccgcttgccggtatgtacacagccatggagcgggcggaaggggaatgctatattttttcggcctgtgacaccccgcttgtccggcaggagaccatatcggctttaaaacggcagttgaccccggcggatgacgccgtcgtgcctgtcgcagacggaagggcgcagccgcttgttgccgtctaccacagaagggtaaaatccgtcctccatgaacagcttcagcagaacgaactgaagatcagcagttttctcgaccgcattcgcgtcaagtacattgaagcagatgcggttggtgcagagccgtgggaatttataaatgtcaataaaaagtcggatttagaagaaatagagccgttctttccgggatgaaatattttatcatagattgcaagggtttttcggaaggtgtttttcaaagaacagcagacggaaaaatggtatgatatagaaaaggaagtaaaggggatcatcctgatgcatgaacggtattcaagacaaatcagatatcaaaacatcggacaggcgggtcaggacagaatcaggcagagccatgttttgatcgtcggggccggggcgcttggcacgtcagccgctgaagggcttgtgcgcgcaggcatcggcgcactgtctattatagaccgcgattatgtggaatggagcaacttgcaaaggcagcagctctacacagagaaagacgcggaggaaaggcttccgaaagcggcggctgcaaaagaacgtctttccgagatcaacagcggtgttgagcttcgtacatatgttgcagacggcacagttgaaacactcagaccgctgatcgaagaggcggatgccgtcattgatgcaacggataactttgagacccgcatgatcatcaatgaccttgcgcaggagacgggtactccgtgggtttacggcgcttgtgtcagcagtcagggcatgtatatgacgattattccccaaaaaacgccatgccttgcctgcctgtttgaagatgttccgattggcggggctacatgcgatacgtcggggattatttcgccggccgttcaaatggtgtcggcttatcagcaagctgaaattttaaaaatcttaactggacagcaagaagcgcttcaaactgcttttgtcacgtttgatttatgggcgaacacccattatcgcatgcagatcggccgcaatgagaaatgtccttcatgcggagaaacgccggtttatcctttcctcagcaacatgagccaaaagaaagccgacgtgctgtgcggaagagagaccgtccaaattcgcagcgaaatgttaaaacggctgcctaaagaggagctcatgaaaaagctttcggtcatcggaaaagtggatgcgaatgattatttgctgcatgtacaatatgaggcgttcagaatcgttattttcaacgatggaagagcccttgttcacggcacaaatgatataaaagaagccaactccatattggcgagagtcatcggaatgtaacaacaggaggtttttttaaatgattgaaaaaagaacgcccattccagtttttgaagccgctgcgcgtgtctctcagcaccagaagctgggagatgcagagtggattcaccttgaggagagtctccatagatttttagccgaagatgtcaaggctgatcacgatgtacccgcttttgaccgttcgccatacgacggctttgctgtccgagcatgcgatacagccggtgcttcgggggaaaatccgctgcaattcgaggtggttgatcacattggagccggggccgtatcggataaaaagctgggttcttttcaagccgtcagaattatgacgggagcgcagattccggagggcgctgatgcggtagtcatgcttgagctgacaaaaaccttctcggaagacggcaaaaactatatggtgttgaagcgctcactacagccgggagaaaatatatcaaaaaccggagaagatgcgagaaaaggatcagttcttgtgaaaaaaggaacccggataacgccgggtgttgtcgctttgcttgcaacattcggatatgcagcggttcctgcagtcaaaaagcctgtggtaggcatcattgccaccgggacggagcttctgaatgtcagcgatcctcttgttcccggaaaaatccgcaacagcaatgcaggcatggcggccgctcaggttgaagaatcaggcggaaaacccctttatttaggaaagatttctgatcaatttgacgaaagctttgcagcggtggaaaaagctttggacaaggtggattttctgattacgaccggaggggtatccgtaggggactttgattttctgccggcaatttacgaaaagctcggtgccgaggtcctgtttaataaagtggcgatgcgtcccggaagtgtaacgacggtcgctcaattaaacggcaaattgctgtttgggctgtccgggaacccgtcagcctgcttcgttggatttgagcttttcgtcaagccgtccctgcgcacctggctgcatcatccgaagccgtattctttatgtgcagaagcggttttagccaaggattttccaaaacctaacccgtttacgaggtttgtccgctcgtttgtatccattcaagacggcgcgcttcaggcggagcctgtcggtctggataaatcgagcgccgtaacgtctcttgcagatgccaatgcgctgatggttttgccgggcggaacgagaggctttgaagccggggcaagagtgcatgttcttttataccgggatgagaacggaagtgaacagctgtggccgcacattttccaatcctccagatcgtagggtaccaaaacagcggcaaaacgacgttcgttgaaaaattggcgggaaagctcgatcagctaggagtcaatgttggctgtctgaaacaccacggacatggaggagaaccggacgcttttgccgaagggaaggattccgaccgcttttttcgggctggagcggctgcgtccggcgtagaaggtgcgggcgtttttcagcttacggcgcgcggcgagtggacgcttgatcaactgattgccgcttacggcgttttagcagttgagtgtctcctcatcgaaggatttaaacatgcgccatatcaaaaagttgtcatggtcagaaacgaagcggactgccggctcctgaaggaattggacggcatcatcgccgtcatttaccagcagagcgagccgaaaacagatgttccatcctttcatattgaagacccgggtgccctggcttttattctgaatcatctaaaggaggaaggcgtttgtctgaacgatttatcataacaaaagacccgattgtcatcgaagatgtcgtcaaaaaagttgaaagaagggaagccggtgccgtcacgacgtttatcggaacagtgagagaatggaccaacggaaaaaagaccctctatctcgaatatgaagcttatgttccaatggcggtcagcatgctcgctcagatcggcaaagaaatcaatgaaaaatggcccggcacagctgcagccattacccatcgcatcggcaggctggacatttctgacgcggccgttgtcatcgccgtgtcgtcgcctcaccggaaagcggcgtatgaagcgaatgaatatgcgatcgaaagaataaagcaaatcgtcccgatttggaaaaaagaacattgggaggacggcgagacttggatcggcgaccagcttgagacaactgaatacccggaagggaaaccggatattgaagaggcggcttccggcagagaaagaggtgctgaccattgattaaaattttgctgtttgcccagcttgcggaacaagcgggtgcgcagagtatcgatatagatgaagaaaagacgacaacagacgagattagacagtttttaaaagaaacgtacaatcttcaggggacggaccgggcgatgatcgctgtgaacgaagtgtacagaagaggaaacagtgaggtcgagtcgggagatacggttgcttttattcccccggtcagcggaggatgagaacgtcggtcggttcaggcataagcctgtcaccgaccgacgttttttttagaaccgttctctatataaagaaaacagccgcgccgttctttcgaaatgtttggttctaatttttgaatcaggtcataaagctcactaatacggtgaacgttaaaattggttctttccttcagtttcattttcagttcttttgtcgttacaatttctcctttttgctgtttaataatgtctacgcaatgtgctgcataatactctttattggaacgtctatgtcgctggatttgtctgtcaagttctcccaaccttgcataaatcccttcgcgttctttccggaagtccttccagattttttgttccaattcacctaagaggagaagccgtttttttaaagcctctcttttcgacattgcaatcaactccgtcattcataatttgataactttttctattattttacatcatcttccttcattcatcaaaaaatttcctttgacatcgagaaactattttttatcggctgtcacattttaaacaggctttatttcaaaccgaagaagggggaaaactccataataagactgaattttttaaaaacggtggaattttatttcgtaaaccgatatattagatgatgtgtccttgttttacatgaattggaaaggtgctggtgctaatggagtcccttaaaaaactaaaagatttttattggccttataaaaaaatgtttttatggtcgattgcgtcgatgcttctaatgacggcgattaccgttgtttatccgattattctgcaaatgacaattgatgaagtaattctcggcggaaaatacggtttggtcatatggatcagcctcgggttcatcgctgtcatggcggcgaagggcgcagccactttttttcatcagtatctcggagatatgttcggaattcgctctgtctaccggttaagaaaagagctgtatgcgaaattgcagcgtctgccgttcaaatattacgacagcgctaaaacgggagatttaatgtcaaggcttacggcggacgtcgaaggcatcagattctttttatctttcggctttgctgaggcgattcgatttatcctgcttgtcactttcagtctgtctgtcatgttttcttattctgtgccgctgactctggttacgattgcttctctgccgtttttaggagcggccgtctaccggtttgataaaaaagtgcatcccgcttttcggaacataagaaaatcattcgcccgtttaaatacgaaggttcaggaaaatatcagcggcatgaacaccgttaaatctttatcaaaagaagattttgagattcaaaactttactcattcaaatgaccattttcgaactaaaaatttaaacgcttcgtttatcatgtcgaagttctttccgctgatggagtttatcggcaatatctgcctcgtggctctgctgtcgttcggcggctggctcgtgatgcagaacagcttaaaaccgggtgagcttgtcgcttttttcagtctcgtcaattacttgatgtggccgatcatgaacctcggttatgtcatcaacctgttttcacaagcgaaagcatcgggagagcggctgctggaaattcttgatgccgaggaggaaatcaccgataccgaacaggcggtgaaaagcggcagactgaacggcgatgtcgcattcagcgatgtttcccttcaatatacaaaagaaaatgcggaagcattgcatggggtgtcttttcaggctgagcgcggcaaaacaattgggttaatcggcgcgacggggtcaggcaagagcagcatcattcaactgctgagccgcttttatgaaccgacatccggccggatcacgatcgacggcaaaccgcttgaacactactcattaaagatgctgcgctccaatatcggcgtcgttccgcaggaatcgtttttattttcctcaacgatcaggtcaaatatatcgtatggaaagcctgatgcatcgatggatgagattatcgaaagcgcgaaaagagcccaggctcacgattttatcatggagcttccgaatcaatatgatacgatgctcggcgagagggggctcgggctgtccggtggccaaaaacagcggattgcgattgcgagagcgatttgtatgaacccgggcattctcatcctggatgattcgacgagtgccgttgacatggaaacggagcaccgcattcaacttgcattgcgggaagtgatgcgggatcggacgactttcatcatcgctcacagaatctcatccttaaagcatgccgacgaaatccttgttctcgataaaggcgtagtcaaggaaaggggaacacacgaacaattaatggaagcaaacggtttatacaaacggatttttgatttgcagtataaagatcaaaatgtgttgaatgagccgcattttgcaggataggaggctcttgctatggaaaaccaggcgaaaaaacaaacgttgatgaaccggtttttttatacttcagaccaaatcattgaaaagccttttaactgggcgcagatgtggaggctgcttaaatatttaaagccctaccgaaaaaatttgctgccgctgtcgtttttaacggtcatgatctcggcggcgatccggctggcggtgccgattttgatcggcgtctatgcgctcgaccaagcgatcgcaggccgggatatgaatcttcttgtgattctgatctccgtcatcagtgggttgtatcttgtcaattatgttagcaatgtgctgagaatccgctggatgaacaagcttggccagcatgtcatatatgatctcagacagcatttgtttacgcatgttcagcggctgtcgcaccgctttttcgacgagcgttcggcaggttcaatccttgtccggatcatgaatgacatcaattctttgcaggaactgtttacgagcggagtcatcaatttattgatggatattttgcttctttttggaattgtcgtcattctgttctcgctcagtcctgagctgaccatcgccattatggtgacgctgcctgtgatgttcttcatttctactaatctcagaaggaaaatccggcgatcctggcaaaaggtgcgcttaaagcagtccaagctgaattcccatttgaacgaaagcattcaaggcatccgggtcactcaggcatttactcaggaaaaagagaatatgatgtattttgaaggcgtcaacagtgagaactttgaagcctggcgggaagcgacgaaaaaaaatgcgactttccgtccgcttgtagaaatgacaaacgctgtcgggacggccattttaatctggtacggctcaagcttgatcatcaatgaaacgatcacgatcggtgtatttgtatcgttcgccttctatctcggaatgttctgggagccgatttcaaggctcggccaagtctacaaccagctgttgatggggatggcttcgtcagagcggatctttgaatttctggatgaaaagccgagcgttgcagacaaggaagatgcggtcaaaataaaagaattaaaaggccggatcgaatttgaacaggtggaattttcttatgacgggaaccgcaaggcgctgcacagcatttcatttgagatacctgcgggatcatcgcttgcgcttgtcggacatacaggatcagggaagacgacgatcgcaaatctgatcagcaggttttacgatgcaacaggcggggctgtcaaagtggacggtataccgattaccgatatctcgctttccgatcttcgttcgcaaatcagcatcgtgctgcaggacacgtttattttttccggaacgattatggaaaatattcgttttggccgtccgaacgccgccgatgaagaagtgatcgaagcagcaaaagctgtcggagccgattcgtttatttcagcgcttccgaatggatacgccacagaagtggaagaacgcggcaatgtattatcggcaggtgagcggcagctcatttcatttgcgagggcgcttctggcagatcctcgtattctaatccttgatgaagcaaccgcaagcattgacacagaaacggaagtcaaaatccaggctgccttgaaaacactgctccatggcagaacggctattatgatcgctcacaggctttcaacgataagggatgcggataaaatcctggttcttgaccacggccggaaaatagaagaaggaaatcaccaggaattgatcgggaaacgtggaatgtattatgagctggtaaaagcgcagtatcaaatgtttcagcgaaactaaaaccgtccgcgccgcaccttctaagaatgcggccggggcgtttttttgagaacagttgtgaaacattttaggacattctgcgtataaactggtaattcattttttaagggggatacatatggaaacgaatttagaaactgaaaaagtaaagaatccatcattgctcggattgattacccggcccggagaacagttcgagagaatgagagaaaagccggctttctggtttccgcttgtcattgttttaatcttgtcggttgcgggagcgtatatgctcagcgaaaaaacggcgttgtctaccgatttgtcggaaatgccggatgctgaagcatttcaagctgctatgaagggaatcggcatcatcggcgggatcttcggctttgtgattgccttgctgatcagcgctttaatttattggctgattgtcaaaatcggaagaggaacaaccaattttgttcacatgttttcgctgtctgtttttacatattttattgcggctatcggacaattcataggcggactagtgatctattattcaaatatcgatcccacgatcgtcgtcacgtctttaaacggcatcatcccggcagacgagccgctcaaatcggtattgggtgtatttgatattttcacgatctggtcgctctcattggttgccctgggtctccaaaaggttgggggcatctccaaaaaagcggcttggaccggtgtgatcattttatttgtgatctccattctgctcgctttaataggcggtatggcgatcaatttcttcgattcatttgaaggagcaatgtaaatgaaaaaaatatggatcggcatcgtcattgttggggctgctgcgctttttatcggactcaacctctaccgctcggttcaaacgagcggaggggctgaagaagcggttcaaaccgtgaaattggaagaaaaagagatttcttctgaagtcatggttccggggacccttcagtttgcaaacgaacaatacgaatattttgaacctgaaaaaggagaaattgccgacatcaaagtaaaagaaggcgataaggtgaaaaaaggagatgtgcttttcacctatacaaatgaagaaattcgcctggaaaaggagcaaaacgctttatccattcaatcgaaggatctccagcttgaacaggttaagcgaaaaatcagcagcctaaaaagcaaggaagacgagctgaaggctgagctcggagcggaaaaagccaagaggcaaattgatgaagaacggtcacagcttgaaatggaagaaaaatcgctccagcttgaactgaaacaagccgacctgcaaaaggaaacgctcgagaagaaatcggcagcgctgcaagtgaaaagcggcattgacgggacggttattaccgttgacaaacaagccgctgcaaagcaatcggatattcaaaagccggttatacatataggtaacgaggacaagcttgtcgttaaaggcgtgctctcagagtatgacacattgaaagtgaaaaagggacagaacgtgaccatcacgtcggatgtcatccaaaataaagagtggcgtggaagggtatcacaagtcggattggttcccaaagaagaggcgtctgcaggtgctgcgggaacaaaggagcaagctgttcaatatccgtttgaagtcaaaataaaaggggagcgtcctaaagcaaagtccggctttaacatgattctcaaaatccagacggacaaaagaatcgttcaggctcttcctgaagatgccgtcaagcaggatggtgatcaatcatacgtgtttgccgtaagagacggcaaggcaaaacggatcaatgtcaaaaccggtgagaaagcagacggcctcgttgaaattaccggcggtctgacaaacaaggacccggttatcgcaaacccggccgaggatatgaaaagcggaacggaagtgaagcttcaatgattgagctttccaaagtgaaaaaaagctaccaaatcggaggagaaaccattgatgttctcagggagatcgatatgaaaatcgagccgggagaatatctgtccatcatggggccgtccggttcgggaaaatcgacgatcatgaacattatcggctgccttgaccgcccgacatcgggtatttacaggctggacggcgaggatatttcatcatacggcgaaagggagcttgccggtgtcagaaaccgtttaatcggttttgtttttcagcagtttcagcttctgccgcgcttgaatgccataaaaaatgtggagcttccgatgatttacggcggcgttccaagaaaggagcggcgggagcgggctgaacgggcgctcgaaaaagtcgggctcaaggacagaatgcgccatatgccgaacgagctttccggcgggcaaaaacagcgtgtagccatcgctagagcgatcgtcaatgaacctaaactgatattggctgatgaaccgaccggagcgctcgatacgaaaacaagccgggacatcatggagcaattcaccgaattgaatgaggaaggaacgacggtggtgctcgtcacacacgaacctgaaattgcggactatacaagccggaccatcatggtgagggacggtgtgatcgtctcgccggaaacagagcggagggggacggtgcaatgaatctcatcgaaaacttgagaatggctttaagttccatcctttcccataaactgcgatcgattttaacaatgcttggaatcattattggtgtaggctccgttattgtcgttgttgcagcggggcaaggaggagagcagatgctcaagcagacgatcagcggacccggcaacacggtcgaaatctattatcagcccagcaatgaagaattaaccgccaatccgaacgcctacttagacgccggcttcaccgaagaagacatcagaagcttaaagtcactcgaaggcgtgaaacatgtcgttgcgaaaacaaccgagtccatgaatgcccgcttccgggatgaaaatacggatgccgctgtaaacggcattaatgacggatatatcagcatcaattcgatggaaatcgaaaagggaagagaattttcagaagaggattaccttgctggaagcagggtcgccattatttcgccgaagcttgcggaagaactgttttctcagcagtcgcctctcggccgtgtcgtatggataaatagccagcctgttgaaatcatcggcgtattgaaagaagaaaccgggctgcttgcattggggatgaatgagatgtatgttccattttcaatgttaaaatcgtccttcggcatcagcgactatgactctgtctccgttcaagctgagtctgccgacgatctgcaggccgtcgggaagcgggctgcagcggccgtcaacaagaatcacggcacttcggactcgtacgaagtgatgaacatggaggccatagcggccggaatcagccagattacaacaattatgacgatgttcatcggttcaattgcaggcatttctttactcgttggggggatcggcgtcatgaatattatgctggtgtcggtcactgaacggacgagggaaatcgggattcgaaaatcgcttggtgcaacaagaggccagattctgatgcaatttttaatagaatcgtctttaattacactgatcggcggggtgtttggcatcggccttggatacggcggtgcagccctcgtatcgttttttgccgggtggccgccgctcgtttcctggcaggtggtcctcggaggcgtcctgttcagcatggcgatcgggattatctttggactcatcccggccaataaagcggcccgccttcatccgattgatgcattgaggtatgagtaagatggttgagaaacttgaagcagttgcaggaaaaacccaaatgcacgaatggtccatgccagtacgtcagactatcgacaatattgaaaccgcctgagcaggcggtttttttatggaaaagcaaatttgatcaggcatatggtgtatggatgttccggttaaacatgcctatataaagggatgcttggtgcttggtggctacattccggccgagaagcctctattaaatctacttggaatatgcatcagcagccggagaacgatggatcggcatttcaattatatttatatccatgttgcggcctgtcttactatatcaatttatagaaaatattcagtaatcggaaacaggatacagatttgctgtaaaacctcatgcggtgagcatggggttttatcctgtgacctgaatgatgtttgaaggaatagataataataatgtcacatatttttgcggatttttatagtttatacagtttacaaacggtacatatcacgttaatattttaaaatgtgaaagattttgatggttattgaatgaatttgaaagatttttgttgagttatgtcgaaaaagcgtttacaatgaaattgtaagcttaatgaaggcgtttccaaaaggggtgataatgtgttgactcccgaacggcatcagctgattattgacgagattgaaaagcatgatgtcgtgaaaatccagtacttaatgaatttaacgaacgcatctgagtcaacgatcagaagagatttgtcgacgctggaagcccgcggatatttaaagcgtgttcatggaggggcatcaaggctttccgatattcgtacggagcctgacatgctagagaaatcatccaaaaaccttcatgaaaagcgaaaaatcgctcaagaagcggcctcacttcttgaagaaggcgattgtatttaccttgatgccggaacgaccacattgcaaatgatcgattttatcaatccagagatggatattatcgtggttacaaatggagtcatgcacattgaggcactaggtaaaaaaggcattactttttatttattaggcgggtatgtgaagtataaaaccggagcgatcgtaggcggttcggctttatcagccatcagccaataccggtttgacaaaagcttcatcggcgtcaacggcattcataaggaagcggggttcacgactccggatcctgaagaagcgcttttgaaaacaaaagctgtcaaccaggcgaaaaaagcatttattttagctgacgtttccaagtttggggaaatttcattttctgcctttgccggtttagacgaagcaactatcattacagcaggatctgcaaaacattcatttgataactatcaagaaaaaactgtcgtaaaggtagtgaaaacatgatatacactgtaactctcaacccatcggtcgactatattgttcacgttgaagaattttctgtaggcgggctgaatcgttcagtctatgacacgaaatatcccggaggcaaaggaatcaatgtctcacgcgtactgaacagacaccatgtaccttcaaaagttctcggttttatcggcggttttaccgggggatatatcaaatcatttctcgaagaagagaagcttgaaacggcttttcatgaggtgaatggcgacacgcgcatcaatgtcaaattgaagaccggggatgagacggaaatcaacgggcaggggccggtcatcagcgaagaagatttcgcggcctttttagaccagttttcagcgatgaaagaaggggacattgttgtactggcgggcagcattccttcatcattgccgcaggacacatatgaaaagattgcggaaaaatgcaaagagcaaaatgtccgggttgtcgttgatatttcgggtgaggcccttttaaaagcagcagaaatgaagccgcttttaatgaaaccgaaccatcacgagctcggagaaatgtttggaacaactatcacctcggccgaagaagcggtgccttacggaaagaaactcgttgaacgcggggctgaaaacgcgatcgtttccatggctggagaaggcgcacttttatgtacaaaagacggtgtctaccatgccaacgtacctaaaggaaagctcgtaaactcagtcggtgcgggggattcagtggttgcaggctttctcgcaggcattgaaaaacagcttggcatcaaagaagcttttcgcttaggagtcgcttcaggaagcgcaactgccttttcagaggagctgggaacggaagagctcgttcacaagctgcttccggaagttcaagtcaaagcgatataaaggaggaaaggttatgaaaataactgagctactaacaaagcatacgatcaagttaaaccttgagagcagccagaaagaaaacgttatcgaagaactcgtcagcgttttggatcaggctggcaagttgaatgataaagaaggctacaaagaagctgtgatcaaccgcgagaaacaaagctctaccggtatcggcgaaggcatcgccatcccgcatgcgaaaacggcaagcgtcaaagagcctgcgatcgcgttcggccgttcaaaaggcggcgtcgattatgaatcccttgacggccagccaagccatctcgttttcatgatcgccgctacagacggtgcaaataacactcacctcgaagcattgtcaagactgtcgactttgcttatgagggaggagattcgcaaacagctgcttgaagcttcatctgaagacgaaatcatcgacatcatcaatcagcatgataaagatgatgatgaagaagaagagcaggccgaagaggctcctgcaccatcagcaaaaggaaaaatccttgcggttacagcatgcccgacagggatcgcccacacgttcatggctgcggatgctttgaaagaaaaagcgaaagagcttggggttgatatcaaagttgaaacgaacggttcaagcggtattaaaaatggtctgacggcccaggaaatcgaagatgccgttgcgatcattgtcgccgccgacaagcaggttgaaatggaacgctttcaaggcaagcatgtcattgaagtacctgtaacagcaggtatcagacgtccgcaagagctgattgagcaggcgctgaaacaagacgcgcctatctatcagggtaaaggcggcggtgcaaccgcttctgaagacggagctgccaaaggaaaaggcggcggtttctacaaacacttgatgagcggtgtcagcaacatgctgccgttcgtcgtcgggggcgggatcttagttgcgatttcgttcttctggggaattaacgcgaccaagccgggagatccgacttataatgagttcgctgctgtattaaataatattggcggaacgaatgcacttggattaattgtcgctgtattggccggatttatcgcgatgagcattgcagatcgtccgggatttgcgcctggtatggtcggcggtttcatggcgacacaagctggcgcaggtttcttaggcggcctgattgccggtttcttagctggttatattgttgtcctgttgaaaaaagtgttcgctggtctgccgcaagtgcttgacggtttaaaacctgtgctgctctacccgctgtttggaatattcttgaccggaatcattatgcaatatgttgtcaatacgcctgtcaagtacattatggacggcatgacacattggcttgaaggtcttggaacaggaaaccttgtcgtaatgggtattgttttaggcggtatgatggcgattgatatgggcggtccgatcaacaaagcggcctttacattcggtatcgcaatgattgaagctggaaactttgggcctcacgcagccatcatggcaggcggtatggtgcctccgcttggaattgcccttgcaacgactttctttaaaaataaattctcaaaacgggatcgcgaagccggaattaccaactacgtgatgggcttgtcatttattactgaaggtgcgattccttttgcggcagcagatccggcacgcgtcattcctgcttgtatcatcgggtcagcagttgccggcggtctgtctcaatttttccatgtcacactgcaagcgccgcatggcggaatattcgttctcttctttacgacgaatcatgcgctgctgtatctcctcagcatcttgatcggtgcggttgtgacagctttgattctcggcgttttgaaaaagccggttccaactgaaaaataagtgctgaaagtgccacagtaatccctctcgtggcactttcttttttactgtttttgccggaagtgagcgcggggattatgtattcagcgggaacttgtgataaagtataggaaagcttttattttggcatgtatgctgtgacagactgtttttaggaggaagcgttttgactgaagaaaaatccaccaataagaaaaactctctctttgaatgggtaaaagccattattattgcagtcgttctggcgttattgatcagggcatttttattcgaaccgtatttagtggaaggtacgtcgatggacccgacgctgcacgacggagagcggctgttcgtctataaaacggttagatacgtaggcgaatttaagcggggagatatcgtcattatcgacggcgacgaaaagaatgtccattatgtaaagcgcttgatcggcctgccgggagataccgtgcaaatgaaagatgacacgctgtacataaacgggaagaaggtgtcggagccgtatctttcggaaaacagaaaagaggcggaagcagtcggcgtcaagctgacgggcgactttggccctgtgaaggttcccgaaggcaagtatttcgtgatgggagacaatcgccagaggtcaatggacagccggaacggcctcggactgattgataaaaaacgagtggccggaacttcgcaatttgtgtttttcccgtttaacgaaatccgaaaaacagactgaaaaatgcctgatgtccatttggacaatcaggcatttttgcttgatttatgcggataatgatgccagcactgcgataaacagtacggtaacgaacacagaggccataatcagaagaacgctgtacaagattctgatttccgcggcttcttttccccgttttgacagcattcgtttcgccgcgatatgaacgaacacgtaaatcatggcaatcccgatgtaaagccccagatcccgtgctgtaaagccggttatggcaagatagacccctgcaaaaaaaataaacatgcagtattccgtcaaagtgataagcttcatggtttcctccgtctaacgatccgagttttcttcaaatatcacctttttataatatatcttttggagccatcccacaaggaggccgaagccgatcagcagacaggaaaatataaaaaagtcagcggtccacatatcaaaccctttgaaaagcccgatagacatcgtagaaatcaccatggccactgacgcgaaaagcgcttggcgcggcctcgaattaatccatctgatgatatcagggtcatctttcaatttcattattccttcccccattcttcattaattgtaacatattgtcacaaagaaagtggaaataagcgtttttttgatatatttttctttcaaactttatcgtaaaaaagcaaagcatttctcttgcggaattttcgtgttatactcattttaatgaagtatagatggaggatattaaatgatagctgttcaaaatgtcagcttgcggtttgcagaccagaagctgtttgaagatgtaaatattaagtttgcgcccggaaactgctacggattgatcggagcaaacggcgccggaaagtccacttttttaaaaatattgtctggcgaaattgagcctcagacaggcgaagtccatatgagtcctggcgaacgtcttgccgtcctgaagcagaaccactttgagtatgaagagcatgaagtgttgaaagtcgtgatcatgggacatagacgactttatgaagtcatgcaggaaaaagacgcgatttacatgaaacctgatttttcagatgaagacggaatccgcgccgcggagcttgaaggcgaattcgccgagctgaacggctgggaagccgaaggggaagccgcgatcttattaaaaggactcggcattcctgaagaacttcatacgaagaaaatggcagatttgggcggctctgaaaaggtgaaggtccttcttgcacaggccctgttcggaaaacccgacgtccttcttctcgatgagccgaccaaccacttggatattcaggcgatccaatggctagaagagtttttaatcaattttgagaatacggttatcgtcgtatcgcatgaccgccactttttaaataaagtatgtacgcatattgccgacctggattttaacaagattcaaatttatgtcggaaactatgatttctggtatgaatcaagccagcttgcgcttaaaatggctcaggaagccaataagaaaaaagaggagcagatcaaacagctccaagagttcgtcgccagattcagcgccaacgcctcaaaatcgaagcaggcgacatcgagaaaaaaactgcttgaaaaaattacgcttgacgatattaagccttcatctcgcaagtatccgtatgtacatttcgcacctgaacgcgaaattggaaacgatgtgcttgttgtcaaagacctgtcgaaaacgatcgacggcgtcaaggtgcttgactctgtcagctttatgatgaataaagaggataaaatcgcctttacaggccggaacgagctagccgctacaacgctctttaaaatccttgccggggaaatggagcctgacagcggatcgtttaaatggggcgtcactacatcccaagcgtttttcccgaaagacaacagcgagtattttgaaaacagcgatttaaaccttgtcgactggctccgccaattttcgccgcatgaccaaagtgaaagcttcctgcgcggatttttaggccggatgctgttctccggagaagaagtgctgaaaaaagcaagcgttttgtcagggggagaaaaagtccgctgcatgctgtcgaaaatgatgctgtccggcgccaatgtgctgatgcttgatgagccgacaaaccatttggacctcgagtccattacagcgctgaataacggtttaatcagctttaaaggcgccatgctgtttacatctcatgaccatcagtttgtccaaacaatcgccaaccggatcatcgagatcacgccaaacggaatcgtcgataaacaaatgagctacgacgagtttttggaagacaaaacggttcaggacaagcttgctgaactttacgcgtaatgatagaaaacccgccttaaaaagcgggtttttttttataaaaaggagatggttgctgtgtcatgccgaaaggctcttgagcaatatattcaagcaacaaacacacatgagtttgagaatgtcaaagccctccttgaccccggcgctgtgtactggttttcggatcaaacgtgctcgggctttgaggagattcagcgttattttgaaaacgcctggaagcaaatcgaaaatgaagtatacagcgccggtcatgtcagctggatcacggaaacggacgaacaggccgtctgtctttatacatacgaatggaaagggttatataggggcgaaccggttcaaggggcaggccgtgcgacaaacgtatttgtaaaggacgagtcaggacgctggaaactgaagcatgaacatttaagcagtttgcccaagcgatgaggcggcggagcatggacctgattttcagctgttacagccgccatgcatgtacagggaagtttaggattgcgggcggcatgcggacacgatataaaaggacctcagaagttttctgaggtctttttttgcggaaggctttatatcgcccagttgccgtttctgaatatcggctctctttttccgtcagcagtgattccgtctatattcatttctcctgaaccgatcataaagtcaacatgtgtgatgctttcgtttaatccttctttcgccagctcctcgcgcgacatctgttttccgccttcgatgttgaatgcgtatgcactgccgatcgcgaggtggtttgaggcattttcatcaaacagtgtgttgtaaaacagaatattggacttggaaatcggcgaatcgtgggcaacaagcgcaatttcgcctaagtagtgtgaaccctcatccgtttcgatcagctcttttaaaatttcttcgccttgtccagctttgacatccgtaatccgtccgtttttaaatgtcagtgtaaagccgtcgattaaattgccgccgtagcttaacggcttcgtgcttgaaacggtgccgttcaccccgtcttttttcggagcagtgaatacttcctctgtcggcatattggccatgaactcgacgccgttttcgtttgtgcttccggcgccgacccacagatgcttctcgggaagctcgatcgtcaaatctgttccctttgcttggtaatgaagggcgtgataatgcttgtcgtttaagacgcttactttatcgcgcaaggtttgatcgtgatctttccacgcttgaacgggatcttcacggtcaacgcgggtcgttttgaaaatctcattccatagcttttgcacggctgtctcttcatctgcctcagggaatacttttttcgcccaggccggcgaaggcgctgcgacgacagtccagctgactttatccgattgaatcatttgcctgtatgtatgcatcgcttttcctgcggctttctgctgtgcggagatttttttggaatcgatgcctttcaaaagatcaggacttgaagagacaatggaaataaaagcagcgccttctttggcgagcgtctcaagcccctttgcttcccattcagggaactcttcaaaggcttccgcaggagccagctcgtatttcagccttgtgacctcatcatcctgccagcggaccgtcacgtttttcgcccctctttgataggcgcttttgacgaggagccgtgcaaaatcgcgtacttctgttgacgcgttgatgacgacttgctgtcctttttgaacgtttacgccgacttcggccacaagctttgcatatttgctcagtttatcagtaaacgaattcattggcaaaacctcctttattgtccataacatcatatcaaatatttgattgaaaagaaaaaaagaagcagcccggttcaggctgcttcttttttaacggttgattttggccgtttggccggggggcgagcttggcatgtttgcaagggagatgctcatccccccgagaataataccgcttaaaataacggtgatggccaggcgtcttcccatatctctaagcatggtcttcctccttatcgtttctccattcctcacgatatgaaagaagccgggaaaaaagacgcgaaaacaaaaattatttagccgctttttgcaatttatcgatcacttcgagagaacgacccgttccgatagcgacagattcaagcggatttgcagcaacatgcacgggcacaacgatttcctgtgacagccattctttgatgccgttcaaaagcgcgcctcctccggtcaaaatcacgccccggtcgacaatgtctccgctcagctccggaggacagtcttctagcgtcgctctgatggcttcgataatatgcaggagcgattcgcgcatcgccttctgaatttctttcgattccagggtaatcgttttcggcaggcctgtaacaaggtcgcgtcctctgacttccatcgttttcgtctcatggtcaatcaatgcgtagccgatctcaattttgacttcttcggccgtccgttcaccaatcagcaggttgtatttttttctgacgaatgacacgatgtcttcatcaagctgatcaccgccgatccggatcgagtggcacgagacaacgcctccgaatgaaatgatcgccacttctgtcgtgccgccgccgatatcgacgacaacgtttgcgacaggttcatcgacaggcagatctgcgccgatggcggcggcgacaggctcctctatcaaatggacttgtttggctccgcagtttttgacagcatcgctgatcgcgcgcctttcaacagcggttgagccggacggcgtgcagacgacgacgctcggctttctgaacgtaaagccgatgttctttccggcttttttcataatctgcttcaagaggtctgtcgtcatgtcataatcggcgatgactccgtctttcatcggcctgaccgcgacgatttttcccggcgtttttccgatcatgtttttggcttctgtgccgaccgccaatacgctctttgtttccgtgtccacggcgacgacggaaggctcatttaaaatgattcctttgtttttgctgtaaaccaatatgttagctgtgcctagatcaattccgatctcgattgtttgaaacatgttttcacccaatctctatttaaaatttttccgaaaaacgaaattttcttcgtgctgaaaaaatgaatttcatttaaattttctcaaatcatcggcgatttttgggggtttgtgacgattttgaaaccaatctgtaaaatgctgtcctcatatttacatgatgagaaaattatttcatttttatgaccggatttttgtcgaagaaacgcttgataagggaaacctttttcagtcttcattcgtctatcgttatgctaagacaatatcttagaaaaatagaaacaatagaggaagtaggcgaaagttttgaaagcaataggagttgtgagaaaagtagacgaactcggcaggatcgtgatgccgattgaattgagaagagctttggatatctcgatcaaggacagcatcgaattctttgtcgaccaagataaaatcgtcctgaaaaaatataaaccgcacggtgtgtgtctgatgaccggtgaaatcacttctgaaaaccgcgagtatggaaacgggaaaattacgctcagtcctgaaggggccgaattgcttttggaagaaatcaaagctgccttaaacggagtgaaagcataacattcgacgcccttcatcagaagggctttttcttgcgccgggagcagataaaaccgccgtcactgaaaaattcagccatagagacgataaatacttcgaacaatcctctcaaatgtggtgtaaagaatgttacaattgactgagaaatacaagtggcaggtgggggtatgaaaagatatcaaggacgaatcattgcaaccgtgctggcaatgacttttatcatgttttggaattttttattctatggggtgttgggaaataaaatcaattggacggttgatctgctgtttacgctggtgacattaatcagcgtttggtggctcacactttatatcgatgagtcaaatcagcttgtctataaattgaaggaaagcgaaaagaaatataaagagctttcctcagaaaccaaccgcataatggataatcttcaggaaatcgtctttcaaacggaccggataggatacattacatttctgaatcaggcgtggacaaccctgaccggatacagtgtcgaagagagccttggaacgatgtacaacgattattttgaccatgaagaacggatctcgaatcacctgatcgcccagttgaagaacaaggagcccgaaggcaggatcgaggtgctctaccatcgcaaagacgggagcaagttctggggcgaagttcactataaactttattataaaaacggtcaatttacgggcagcttggggacgctgactgatgtgacagaacggaaaaaagcggagatggaactgtttaagtcgaatcagcggctggccatgcagtctcaaaagctggcgatggccgggcagctcgcagcggggatcgctcacgaagtcaggaacccgctgacatctgtaaacggatttttgcagctgatgaaagcggaatatcctgaccggaaagattactttgacattattttctcagagattaaacgaatcgattctgtgctcggagaactgcttgtgctggccaaaccgcaccaggttcaatttaaaaagatcaaaatcaattcggttcttcagcaagtggcaacgcttcttgagacgaacgccgtgctttcccacattaagatcgaaaaagcgtttcagcacggggaggagtgggaaataaacggtgatgaaaatcaaatcaaacaggtattcatcaatttaattaaaaacgggatagaagcgatgcctgacggcggtaaaattacgatttcctcaaaggcagaaggagactgtgtgaaaatcagcatcaaagacgaaggcgggggcatttcccaagccgacttggcaaagctcggggagcctttcttctcaacgaaagaagaagggacaggtcttgggctgacaatttgcctgaatatcatcggcgcccacaacggagaaatgaaaatcgacagcaaattgggcgagggaagcacattccacattttgcttccggtcgataaaggtgcggcgtccgaagagaacgacattcagcaaggatgctgcagccgcgcaactataaaataaaagaggaaaaattccacttcatatgatagaatttgttcaagattgacccatggaggaattaccgatgaaaaaagaatttgcagtaattggactcggccggttcggcggcagcatttgcaaagcattgagtgaagaagggcttgaagtaatggcgatcgacagagatgaagatcgcgtaaacgaatacgccaaaattgcaacacatgctgtgataggagacactacagacgaatctgtgctgaaaaaccttggactgcgcaattttgaccatgtcattgtagcgatcggggagaacattcaagcgagcattttgacaacgctgatcttaaaagagcttggtgtgaaaatgattaccgtaaaagctcaaaacgattatcatgaaaaagtattatccaaaatcggagcggaccggatcgttcacccggagcgtgaaatgggaaaaaggatcgcccacaacatcgtctccaacaatgtgcttgattatctggaactttctgatgaacacagccttgtcgaaatcgcagcgaacggcaaactggccggaaatacactgcttgaccttgatatccgggccagatacggaattaatattgttgcgatcaagcggggaaaggaagtcatcgtatctccgcttgccactgaagaaattcagaaagacgatattttaatcgtcatcggctcaaatcctgacattgagagatttgaaaaaaaagtctttcaacattaaaatgccaccgattaaccgcgggaaccccacagcccgcggtttttttgatcttttcattgactgtttcaagcgattcggctacgatattgaaccatatacatataaaaaagagaggggacatatacctttggacaaagagatgttcattcgccggcttggcgccgccagtcatcgcaaaaaagcggaaactgtaattaaaaacggaaaaatcatggatgtttttaatcaggaatggttggagacggacattgccatcacagacggggccatcgtcggcttgggcgaatatgaggggggaaatatcattgacgctgagggacaaatgatcgttcccggctttatcgacggtcatgtccatattgagtcctcgatggtgacgccgcccgaattcgctaaagcggtgattccccacggtgtgacaaccgttgtcaccgatccccacgaaatcgcgaatgtctcaggtgtgaagggtcttgagttcatgttggagcaggctgagatgaccaggctgaacatttattttatgctcccttcttgtgtgcctgcggcaccattcgaaaaatcgggtgcgattttgaacgccgcggatttacatcctttttacagccgcgaagaggtgctcgggcttgcggaagtgatggactatgtggccgttgaagctggagagccggatatggtgcaaaagctcattgatgccgataaagcgggcaagcggatcgacgggcatctggccggcttgtcagccgggtttgtcaatgtctacagagcggcgggcgtgcttacagaccatgaggtcacaacacctgaagaggcgcttgaacgagtgagaagagggatgtacgtcatgctgagagaaggttctgcggcaaagaatacgcgtcatgttttacctgcggtcaacgagaaaaatgtgagacgcttctttttctgtacggatgataagcatctggacgaactggtcgatgaaggaagcattaactaccaggtcaagcttgccattcaagaggggcttgacccgtttctcgcatatcaaatgggcagcctgaatgcagcggaatgcttcgggttaaagacgaagggagcggtcgccccgggttatgacgcagatcttcttttcatcagcgattttgagaacgtgagcattacaaagacgatgattaacggcgtgatctggagcgggacagagcaaagccaatcgacgggcggcaaagcggcatccggtctgcttcaatctgtgcatctgtctgatttacatgagaacgatctgcaaattccgatcgttcaagagaatgaaatcagggttattgacattatccccaatcagctcgaaacaaagctgtccctggccaagccgaaaagcggagctttttttcagccggatctggaaagcgatctgttgaaaattgcagtggttgagcgccatcgcggcgttaaagaaatcggactcggcgtagtcagaggcttcggtttaaaagaaggcgccatcgcgacaaccatttctcatgattcccacaatttaatcgctgtcggtacaaatgatcaagacattttaaaagcgattgaacgcctcggagaaatcggaggaggcctcaccattgccaaaggagggaaggagcttcaatccgtcgcactgccgatcgccggcctcttgtcggacaaaccgcttgagacggtcaacgaaagcttgaaatctctccacgcggcaataacagagacaggattttcaggagcgtttaatccttttctgacgctttcttttttagcgcttccggtcattcccgacattaaaatgacaacggaaggattgtttgatgttaaagcgttcaggcatatcccggttcaaccataaaaaaacggatgcaccccggtgcatccgttttttgctgtatccgcatccgcgattagacttccataataatcggaaggatcatcggccggcgttttgttttttcatagaggaaaggagcaagcgtgtctgtaatctcgttcttaatttcagaccactgtgtcgttttgcgctccatcacttttttaaggtgtcctgcaatcagttcctgggcatcattgattaaatcaccggattctctcatatagacaaatcctctggaaattaagtcaggccctgcggacactttgaattctttcatgttgatgctgacaacgacaatgacgagcccttcttcggaaagaatccggcggtcgcgaagcacgatattgccgatgtcgccgatgccgcttccgtcaatataaacattgcctgacgggattttacccgcaactgaggcttcttcgcttgtcaaagcaagcacttccccgttgtccataataaagcagttttcctcaggaattccgcagtctgtcgccagtttgacatgcattttctgcattctgtattcaccgtgaatcggcatgaaaaactttggcttgatgaggcggagcatcagtttttgctcttcctgtccgccgtgtcccgaggtgtgaatgttagtcacagctccgtggatgacatcggcacccgcccggtaaagctggttaatcgtgcggctgacgctgatcgtattgcccgggatcggagatgatgaaaatacgaccgtatccccgggattgatggagatttgccggtgtgtgccgtttgcaattcgagatagagcagccatcggttcgccttggcttccggtacagagaatcgtcactttcccggcagggagcctgttgatttcattcgcttcaacgaaagtgtttttcggacacttaatatatccgagcgtttggccgatttcgatcgccgactccatgcttcgcccaaatacggcaaccttccgtccgtttgcaacagccgcttcgatcacctgctgcaggcggtggatgtttgacgcaaaggttgcgaagatgatccggccttcgacttttcggaaaatatcatcaatgctttctccgactttgcgctctgacatcgtgaaatcagggatttcactgtttgtgctgtctgacagcaggcaaagcacgccttcttttccgatttcggccatctttgtcaagttggcgggttcgcccaccggtgtaaaatcgaatttaaagtcaccggtatgtacgatgtttccttgcggtgtttttacgacaatcccgtatgagtccggaatgctgtgggtcgtcctgaaaaaagaaaccgacgtttttctgaatttgacgatatcgtcttcttcaatgatatgaagctttgtttggcgaagcaaaccgtgctcttcaagcttcttcctgagaaggccgatggcgagctgtccgccgtaaaccggaatgttcacctgtttgagcaggtacggaattccgccgatgtggtcttcgtgtccgtgcgtaataaaaagacctttgattttttcttcgtttttgactaaataagtgtagtcagggatgacatagtcgattccgagaagctcgtcttccggaaacttaatccccgcatcgatgagcacgatctcgtcctggaactggaccccgtacgtgtttttgccgatttccccaagtcctccaagggcaaatacagccgtttggtcatttttaacaaatttcattcattcataactccaatactttaaaattttcgctttgcttttcatattctaaaaaagcgccttcaacttgctgtataaactcaatattgtagttgtatggttttaatttagatctgacttcacgttcagattgagcttccacaaaaattgaatctgttttttcacgaacaggtacttcgtcattgcttgcttgataaaataccttatagatcatccaaatctctccttaactgccgattgttagactcgtctttctattatattcgaaattggctcataagaaaagcgcctgagaaaaaaaggacccttccacacgagtgaaggtccttttaggcaatcgactttctgcgcatcatgccattcagctgtttttttaattttttccgcagacggcgaagcatacgggttcctcctttctctgacttgtctgagtaacttccgtatctctttagttctattatatgatgaatccgtctattgttacatggatattattggcatgttgatttagttttgattttggagtgaaaaggttttctcgcgtacgcagtttttgtatgatggtacaggagaaccatcaatcatactagctaagggagaaggattcactgccatggataaaaagctgattttctttgatattgacggaacgatttatgatcacaataaacgcattcccgccaccgcaaaacaggccgtctccgatttgaaagcgcacggccatcatgttttcatcgcgtcaggccgtgcgccgtttatggtcaggcctgttcttgaagaactgggcatcgattcttttgtctcttataacggacaatatgtcgtttttgaaggagaggtcatttataaaaatcccattgccgagcagtcgttagaagcgctgcttgcgcattcggacagctgcggccaccccctcgtcttcatgggggaagaggggatgcgctctacaactgccgcccatccgttcgtcgatgaagggatcggcagcttaaaagtcaatccgccggaagaggatcgtacctactttaagggcagggacattttccaggtcctcttgttctgcacgcaagacgaggaagagcggtacagccggtttaaagagtttgatctcgtccgctggcacgagcgctccacagatgtgctgccttcaggcggatcgaaagcggaaggaatcaaaaaagtcattgaaaaacttccgttcgacagagaggatacttatgcgttcggggacggtctgaacgacctgcagatgatcgaatttgcgggaaccggagtagcgatgggcaacgctgtgcccgagctgaaaaaaatagccgactttatcacaaagcccgtcgatgaagacggcattcaatacgcggtggaagcgctcggacttttgaaatcataaaaaacggatcagaaatgatccgttttttttatgactttacctgcctacaggcgttgcattttcaggttgtttcagcgggttttctttgtcgatgtggtcgtaaaacataatgccgttcaaatgatcgatctcatgctggaatacgatcgccggatatccttttaagcggatgtcgatgttttcgccttcaagcgtcgttcctttgactcggatccgttcatagcgcggaacatatccgggaatcggctcgtcgacggacaggcagccctcgccgcttgtcaaatagcatctttgaacagagtggctgacgatcttcggattgaaaagcgcatagctgtatagtgtcccgtcttcgctttcggcatgaacggcgatcattcgtttattgatattaatttgcggagcggctagaccgacaccaggacgaaggttgtactttttagcgatttcggggtcctggctgtttttgacaaactcgatcatttcgctcagctgtttgatttcttcttcgcttgctggcaattgaacttcttcggcgacggttctcaaagcaggatgaccgtcgcggacaatgttttccattgtgatcaacatcttcactcccaacgattcattatgtaaagtatagcggatcttgctctttccgcgcaatctctgtgcatgataaaatgaccagcctaaaggaggctggtcatgacggatccatcaggggctagcagcctaaataagcggcccctacaataatcagcaaaataaagagaacgacgatcaaagcgaatgtgcggccgtagccgtatccataaccgccgccgtacccgtatccagggcagcaataaccgtacatataaagacctcctccgttattttacgcacagccttttctttttagtaggcatggcgtctaatataaactatgtaaaagtccaaaggttgtatagtcgaatgcccagcttcaaggaattttccctaaaggtttggtctaaaagcgaaggcggttgcataccgatctgatatcggcttgtccatatctttagacttctgttgtcaaacaagcgaattcattttatagtggaatttgtcgagattgggggaagttcatagtgaaattttcaaatatgcgggtgcccgcaggcatcgtcgttttttgcacggctgcatttgtattaacaggctgtctctggaaggatcctgtcgagtcgtttcacggctcgctggagaagatcgtggaattggaagagccttttaaacaagagcagggttcacttaaaagtcttgaaaaagccgaatcgaagctttacgaggaaatgatcaggctcaatatggatgattttgaccggatcgctgcgctctccgacaaagcgctgaagacagccggcaaacgcgagaagcacttgaattctgagaaagaaagcatagatgaagcaaagcaggagtttgaagcaaataaagcgtcggcagaaaaaatcgatgatcagaaggtcaggaaaaaggctgagaacgctgcatcttatatggaaaagcgctacaaagcatacgactctctttatggcgcctatcaaaacgcaatcggccttgacaaagagctgtacaagctgctcaaaaataaagggcttaaactggatgaccttgaggagcagctgaaaaaaatcaatcaatcgtatgacaaagtgctgaaagaaagcaagcatttcaatgagtatacaaaggactacaacaaagccagaaaagatttttacaaggctgcggggtttgagatgaaagagggctgaattgttcagccctctttttttcgacaaaatctgtatcgctattgtaatacagattgttatctatactagaacagtttgcagcagtcttgacaacgctgaaacagaaatccgataaagcgaatacatttattgaaattcaggaatgaaaacgattgacgatcatgatcgactggtgtaaacttagccttggtggaacttgttgtattagtttgtcataaactataagtgatacagttttagaacgcgttgtgctgtccttacataaaagtttcgacaaccatcaaagcggctaataagaaataaatatgagttgcgcccgtcaatttaggacaccctaattctgtatgtataagggatacacgtctatgactgtcaaaagaaaggaagaggtgactttatatggctgcaaaaacgaaaaaagcaatcgttgatagcaaaaagcaattcgatgccattaaaaagcagttcgaaacgtttcaaattttgaatgaagaaggcgaagtcgttaatgaagcggcaatgccggatctatctgatgatcaattaaaagaattaatgcgccgcatggtgtatacacgcattttggatcagcgttctatttctttgaacagacaaggccgccttggcttctacgcgccgactgccggtcaggaagcttctcaaattgctacgcatttcgcgcttgaaaaagaagacttcgttcttccgggctaccgtgatgttccgcagctgatctggcacggacttccgctttatcaagcattcttgttctctcgcggacacttccgcggcaaccaaatgcctgacgatgtcaatgcgctttcaccgcaaattattattggtgcgcaatacatccaaacggctggcgttgcactcggcttgaaaaaacgcggcaaacaggctgtggcgatcacctatactggagacggcggtgcttcccaaggtgacttctacgaaggaatcaactttgccggtgcgtataaagctccagctattttcgttgttcaaaacaaccgctatgcgatttcaacacctgttgaaaagcaatcagcagctcaaacaatcgcccaaaaagctgcggctgcaggtatcgtcggcgttcaagtagacggaatggatgcccttgctgtatacgctgcgacacgcgaagcacgcgagcgcgctgtaaacggcgaaggccctaccctgatcgaaacgctttgcttccgttacggtcctcatactatggccggtgacgatccgacaaaataccgtacaaaagaaatcgagaatgagtgggagcagaaagatccgcttgtccgtttccgcaagttcttggaaaacaaaggcctttggtctgaagaagaagaaaacaaggtaattgaagaagcgaaagaagaaatcaagcaggcgatcaaaaaagctgacgaagagccgaagcaaaaagtgaccgacctgatcgacattatgtatgaagagcttccttacaaccttgtagaacaaaaggaaatttataaagagaaggagtcgaagtaagccatggcgcaaatgacaatgattcaagcaatcactgatgcgttacgcacagaactgaaaaatgacgaaaatgtcttagttttcggagaagacgtcggtgttaacggcggcgtgttccgtgcgactgaaggattgcaaaaagagtttggtgaggatcgcgtatttgacactcctcttgctgaatctggtatcggcggccttgcactcggcttaggcttacaaggcttccgtcctgtaatggaaattcaatttttcggctttgtgtatgaagtgatggactctgtttccggacaaatggcacggatgcgctaccgttccggcggccgctggaattctccggtgacaatccgttctccgttcggcggcggtgttcatacgcctgaacttcacgcggacagcttggaaggactcgttgcacagcagcctggacttaaagtcgttattccttcaactccgtacgatgctaaaggacttttaatctctgcgatccgcgataacgatccggttgtcttccttgagcacatgaaactttaccgttcattccgccaggaagttcctgaagaggaatacacaattgaaatcggcaaagccgatgtgaaacgcgaaggaaaagacctttccatcatcacatacggagcgatggttcacgagtcattaaaagcggcggaagagcttgaaaaagaaggcgtatctgctgaggttgtcgaccttcgcacagtcagcccgcttgacattgacacgatcatcgcgtctgtagaaaaaacaggccgcgcaatcgtcgttcaagaggcgcaaaaacaggctggagtagctgcaaacgttgttgccgaaatcaacgaccgcgcgattttgagcctcgaagctccagtgcttcgcgtcactgctcctgatactgtattcgcattctctcaagctgaaagcgtatggcttccaaaccataaagacgtgcttgaaactgcgaaaaaagtattggaattttaattagatctgaacaattcaaaagggaaaagctgatatcagcctttttcccttcatgcatttccacagtcagtcggagaaactgtagccgtgtactgacagtcggcctaaacaagaggccgaccactatatcaactacgtaataatcttaggaggtcgagaactgtggcatttgaatttaaacttccggatatcggggaaggaatccacgaaggcgaaatcgtgaaatggttcgtcaagccaaacgacgaggtaaacgaagatgacgttttggcagaggtacaaaacgataaagcagttgtagaaattccttcacctgttaaaggaaaagtattagaattaaaagttgaagagggaacagtcgcaaccgttgggcagacgatcatcacatttgatgcaccaggttacgaagatcttcaattcaaaggcgacgaatcaggcgaagcgaaagcggaagaagctgaaaaacaagaaactgatgcacctgcagaagcagcggaagcaaacgagcaagcggatgcagatccgaataagcgcgtcattgcaatgccatctgttcgcaagtatgcccgcgaaaaaggcgttgatatcgtgaatgtttcaggttccggcaaaaacggccgcgttctgaaagaagatatcgacagcttcttaaacggaggaactgccggagacgctaaggctgctcaagctgaagagaaagcagaacctgctgcacagcaacctgcagctgcggttcaagtgcctgaaggcgaattccctgaaactcgcgagaaaatgagcggaatccgcaaagccattgcaaaagctatggtcaactcaaaacataccgctccacacgttacattaatggacgaagtcgatgtgacaaaccttgtcgctcaccgcaagcagtttaaacaagttgcggctgatcaaggaattaagctgacttacctgccttacgtggtaaaagctttgacatcagctctgaaaaaatatccagtcctgaatacatcaattgacgacaatacagatgaagtgattcagaagcactactacaacatcggtattgcggcagacactgaaaaaggcctgcttgtgccggttgttaaaaatgcggaccgcaaagcgatttttgagatttcaaacgaaatcaacgagcttgcgacaaaagcacgcgaaggcaaacttgctcctgctgaaatgaaaggcgcttcttgcacaattacgaatatcggctctgccggcggtcaatggttcacaccggttatcaaccatccggaagttgcgatccttggaatcggccgcatcgctgagaaagctgtcgttcgtgacggcgaaatcgtcgctgcacctgttctggctctttctctaagctttgaccaccgtatgatcgacggcgcaactgcacaaaacgcgttgaatcacatcaagcgtttgctgaacgatccacaattaattttaatggaggcgtaatgtaatggtagtaggagatttccctattgaaacagatactcttgtcattggtgcgggacctggcggctatgtagctgccatccgcgctgctcagcttggacaaaaagtaacaatcgtcgaaaaaggcaatcttggaggcgtatgtctgaatgtcggatgtatcccttcaaaagcgcttatcaatgcaggccaccgctatgagaatgcgaagcattctgaagagatggggatcactgctgaaaacgtaaaagttgactttacaaaggttcaagaatggaaagcctctgtcgttaataagcttaccggcggtgttgaaggccttctgaaaggaaacaaagtcgacatcgtaaaaggcgaagcatactttgtagacagcaattctgtacgcgtgatggatgagaactcagctcagacttacacgttcaaaaatgcgatcattgcaacaggttctcgccctatcgaattgccaaacttcaaatatagcgaccgcgtactgaattcaacaggcgcacttgcactgaaagaaattcctaagaagctcgttgtcatcggcggcggctacatcggaacagagctcggtactgcatatgcaaacttcggtactgaagttgtcattcttgaaggcggagaagaaatccttccaggatttgagaagcaaatgagctctcttgtgaaacgcaacctgaagaaaaaaggcaacgttgaaatccatacaaaagcaatggctaaaggcgtagaagaaaaagctgacggcgtaaccgttacgttcgaagtgaaaggcgaagagcaaacgatcgatgcggactacgtacttgtcactgtcggccgcgttgcaaacacggacgagctcggacttgaacaagtcggcgtcgaaatgacggaccgcggcatcatcaaaacggacaaacaatgccgtacaaacattccgaacatctatgcgatcggtgacatcatcgaaggtcctccgcttgcgcataaagcttcttatgaaggtaaaattgctgctgaagcgattgccggagaagctgcggaaatcgactatcttggaattcctgcggtcgtattctctgagcctgaacttgcatctgtaggctacactgaagcacaggctaaagaagaaggtctttcagtgactgcagccaaattcccgtttgcagcaaacggacgtgcgctgtcattaaacgaaactgacggtttccttaaacttgtaacacgcaaagaagacggcttagtcatcggtgcacaaatcgccggagcaagcgcttctgacatgatttctgagctgagcttggcaatcgaagcaggaatgactgctgaagatatcgcaatgacaatccacgctcaccctacattgggagaaatcacaatggaagctgcagaagttgccatcggcatgccgatccacgttgtaaaataaatcaaaaaccccctctgcagggggttttttatgttttctcttattcgggtgcatgacaaattgcccgggatacatgtgaagcagaaaaaaaatccccttgcacatgcacagggggcttttaatgtttcaattccttttgaagaagccttacaattttatctttatcttttatttttccttcaattttaaccagtactttcttatcattaacaagcagcaagcttggaaagactttaacctcttttttccactcgcctttatcatgtgaaatttccatacttgaaacctgttcgggaaattctttttttaaatccaaaagcgcatcataataagccacttcctgctccatatgctcgtcatcggaaaaaaagatgagcttgaggtggcggtgattggtgctttgatgctgctggtcaggcatgatgtgagataaagaacatccactcgtcaaaaaaaggaaacaaattgcggcggtgaatatcgctcgaaaccacatgacgtctcttcacctctctatataatgcaagccgattttcctgttcgattagtaaacaattcctattttatcatgataattgaaataatttttcgttgttacccatttgttacacaattgataactgccgttttatttatgagatgttgtaggttgagcgtgtttgatgggtacatcgtcggaatcagccgggaagcgttctgcttataccttaagcaggaatacatatataacatgatggcctttttttagaaaaagagcaaaaatgatttaaatgtgttatacaatttaccgttgacaatattaatgtgacataatattataggggtaacaaatttaaacgcttccattttgaaaagaaaagaggaatgaaagatgggcacgatcgtttgtcaagactgcaatgaaaccattcagcattttgaagatgagaaagtgacgatactttacggaacgtgcggacagtgcaactgccatcttaaagaggaagaatagaaaaaagcatgcggccatttacagtgccgcatgcttttatgtttttacaggattgcctgctgttctttaataacgcggatcatatggagggtgtcatcttccggtccctgaacaggcagcccagcttccaggttcttttcgatgtagttgatattatcctcggtaatgatctcgcccggaatgaagatcggtatccctggcggataaaccataacaaactcggcaatcattctgccagctgcttttttgaacggaatgatctccgtgtttgcgtaaaaagcgtcacgcggtgtcatcgcaagcgccggaatgtttggcagaagcacttcaggcttgcgtctgttttccgcagatgaagcggcctgttgagcaatctcggttaatcctttaattaacgcatctgcatcctctttccggtctcccggtgtaaaaatgcacaggatgttgtataagtcagaaagctccacttcgatttggcatgactcgcgcagccatttttccacatcatgaccggtcaggccgaggtctttcacagatatgatcaatttggtcggatcatagtcaaaagccgctttggagccgaggatttccctcccgacgcatgaaatcccgttgatattattgatgcgttcccttgtttcgttggcgagcttaatcgtttgttcgatcagttcgtgtccctctgtggctaagcgttttctggcgacatcaagcgaagcgagcaatagataggaggtcgatgtcgtcgtcagcatgcttaaaatcgattgcaccctttcctttgaaaccagaccttctttcatattgagaatcgaactttgtgtaagggatcctccgagcttatgaacgctcgtcgccgccatatccgctccggcctgcattgccgaaagaggcagatcttcatggaagtggatatgaacgccgtgcgcctcgtcaactagcaccgggacatgaaaagaatgagccagctcgacgatgctttttaagtctgcagctatgccgaaataagtcgggttgatgacgagcagtccttttgcgtcaggatgctcaagcagcgcttttttcgctgattcaggggtgatcccgtgtgaaatccccagctcatcgtcgatttccggatggatgaagatcggtacggcgcctgagaagacgatcgctgacatcaccgatttatgaacatttctcgggacgatgattttgtctccgggtccgcatacggccatgaccatcgtcatgatggcgccgctcgttccctggacggaaaagaacgtgtagtcggctccgaatgcttcagccgccagatcctgcgcctgtttgattattcctttcggcgcgtgcagatcgtcgagaggctcgatgttgattaaatctatgcttaatgcattttctccgataaactccctgaattcagggtccatcccagagccttttttgtgccccggtatatggaactggatcgggtttttgccggcgtgtttttttaatccggtatataggggtgtttcgtgctgcaacaattgttttcccaccttcatgataaacctgctatttccttaaagactattctttatcaaaaatcgttgagttattttgcgtttttgcttgatggcataaaacaaatgaattatattatgttcttgaaagaatgtaaagaacattttatcatctttcctgtaaggggcttctaggtccctatggatagtcgcaaaaaagaaaaccaatactaaagctatacaagccgtcaggctgaactgcacaaggagatgaaccaaatggaagaagggtaccaatatccgatgaatgaagactggagcacagaggaagcgatagacgtcatatcgttttttcaggcggttgagctcgcttatgaaaaaggcgtagagcgagacgtgctgatgagtgcttaccgccgctttaaagaaatagttccgggaaaagcggaggaaaaaaagctgtgcagccagtttgaagaagcgagcgactactctccgtatcaagcagtcaaaaaagcaaaggaacaaacggaagatacgaaaattaaaatgtaatgagaaaatccaaaacaaaaagggatggcaccaccggccatccctttttgattataccgatactttctgcgtcaggcggtaaaggaaggcgagcttttcaaaagccgcttcgatttcggatagaaacgcctcttcactcatatgcagcacctcgtctttagaaagctgaataccgcaaagcgcttctgctttcttcacgttgacgagccgttcaaacaggttttccagatctttttcattcatctcagactgtctcttggcatccggtttcgtatgatcggccgaccagaaaaagcgacttggaatgctgctctcaatatccggcagatgcttcttaaacagctggccgtattcctgcttgagaggggactcatagatcaatgcaaaccatacgaaaacgtgggtttcccataaaccaatttggaaatgcggcagctttttatagccgcgcttattgtttgcgaaagcaacccagctgtcgtccggcggattgactgagcggcgcgcgtgcttggcgacgtggacaaacatttcgtctcctgtcaaagcggacagaacaggcgcaaaatgatcgccgagcccttgaagtttcgggcgcactgtgtctttcagaacgctcatccgcgcatctaaaccttctattgtaaatgtacgaaaatcctcttcagtaaaacgcagactgctcattgtgttcctccttgtccaatcagtaaagatattgtatcacagtcggcttttcaaacaaaaaattacgtttcgccttgcggaatttggggaatcgttaggtaaacacacaatttttagaataacgttgcgaatgtttgagcacttcatacgatatgaataagaaattaatatatatcacgcttaggacttaaagccagaaggattccttttgaaatcaattttctctggagggggcgtagggcacatgaaaccaatagtaaaacaaggattgaaagaggaaaaagacaatcgggccgctgtttggaggcttgaggtcgattatgaacttgcaacgctttttgaagctatggaaaaaaaggatgaaacccaaatcgagttgagcaagcgcaaactggaacgactcagaaaagaatggatcagattacatggttgaaaccataataaaaacgaaccgtttgagaggttcgtttttatctgggctgcctggatatttgtcatttttcttgatttttcccggttaatatcagtatgctatgaataaatcaacaggtatacatagaaaagaggtagtgtgatgacaaactggaaggaaatcgatcgcctggcgaaaagctgggtgaaagaagctggtcagagaattaagcaatcaatgaaagaaaagatgacgattgaaacgaaatcgaatccaaatgaccttgtcacaaacattgacaaggaaacagagcgttttttcattgaaaaaattcaatcggtttttccggatcatcatattcttggcgaagaaggccaaggggacaagctcacatctttggacggcgtcgtttggatcatcgatccgatcgatggtacgatgaactttattcatcaaaaacgcaattttgcgatttcaatcggcatttttgaaaacggaaaaggcaaaatcggcttgatttatgatgtgactcacgatgagctttatcatgcttttcaaggcgaaggtgcttacatgaacaatacaaagctcggcaagatgaaagaagtgccgcttgaggaatcgattctggccatcaatgcgacatggatcaccgagaacagacggatcgatccaagcgtattatccccgcttgtcaggcgcgtcagagggacccgttcatacggttcagcggctttggaactcgcttatgtagcggcaggcagaatggatgtgtatgtgacgatgaggctcgctccttgggattacgctgccggctgcattctgcttgacgaggtcggcggaacatatacaaccattgacgggaaaccgctcaattttcttgaaaaccacagcatcgtagccggcaatccggcagctcaccgggcgattttcgacgaatatttgccgcatgaatagcaggtctttctcttcttctgatctcgccttttttgaagagctggccgaagcgagccccgggtgggtgaaggaagagcttgacggaaacagcctggaacgctatatgagtgcttatgcgatgtataacggtgaatggctcgtgtgggaagacgggggactgccggcggctctcagctttcatctcgaatgggcgccttctaatggcaagccttggctcggaacgcttcttgtccatcccgatttccgcaaaaaaggccgggcaaaagaagtgatcaaaacgatcggaaaacgcttgagagaaaaggggcataaagcgttgtttgcggcagtgccttatgagaaagacgaatggttgaacatgctggcccgttcaggatttgaacagctgaaaacggaaaaagatgaaaagggaaaacgatatttgatcatggttttgccccttcccttgtggctgcaatgagacttgtttaacaacaggtctctttttttatgattttatgaaacaatatgcagcgtcgtttgtctataaagatgaggccttaatttgatgtaaaggaattgtggaaattgatcgaactatttagtgattatgtgctccattttgaacgttattttgttttaagcagacagagcatgcttgtcattcagtggtgtgtgacaggccttgtccttttgtatgccgtgtcatttcatccgaaagtgtgcaggcggcgcctctttttttatgcaggcatcgttctcaggctgatactggttggcgccctttcgtttgaattggctcaccaaatgaaagccgctgagttttcaaacctgtacatagacgaacaagatgcgcttctgccttttatgcagtttttgctgttcggctatattttgcttgtctcttttcattatatgatgacactcgcggaaaaagggggcaaggggctgttttttgcatttgacattgcggtgatggcgatgccgcttttccaatcgctgttcagctttgccgcctatttgaaggaatttggagcggaggagcttgaagaattgccgctcgttctgttgttgattgtcggaataccgggactgatgatctgcttgttttttcagctttattggaaaagaaaccgttacgttctccttttgattttttatattgtgacgatcggcggtttcttcatcaaaaagcttggatacgaattttttccgctgaacgtatttctgacaatgatcggttttcttatgacatatcacttgctgaatgactcgagaaagcctttgttgatggtgaagcgtgttttagccgcgggcaccgccgtatttttcacgcttcacctcaatcctttttacaatttggcggatgccgcttttacaatctcacacccggaggtttcagacgtggttgatgccaattttcggcctgtttcggttaaagaagcgaagcagactgtcagctcgttttttccgacagagagctttatctatttgtcagctaccaaccaggattttcataacgtttatcatttcaaaacgaaagattacgatgcggacgttgacggctggacgggaatgatcaccaattatcacaatcaaaaaaagcctagcgggaatatcctgtccggtcaggcatatatcaagcggtcgaagcaatttctaagggaacacggccgcgaacttgacaaacaaatcaaggcaaaggtcagccgtgatgacggcgaagctactgttgaattttaccgtgaaggcgaggatcctgaattaagcacaatgtggtttacttggcggaaggagactctgatgggattccatgaggacgcgtctgtttacagcttagaaagcgtgaaccaagcccgcgtttctggtgaggatatcgagcggggagttgaagccgtctatcgtaagctgggcatacccgtctcatcttatcggctgacagatattgatttattattcccattcagcctcaactcggcatccatcaacataaagacaagtgacggaatggggatggagttccaccctgtaacaggtgcattaacggctatttcgatcaaatctgaaagcgccttgccttatcgcggacaagagcttgaaaaacgcttgctttcattatttgatcaagacatttccaatctgaaaagggtggagttagaaaaggatctgatagaatttcagaaaaaagaaagcgatgctgtgttaaatacggtctggaccatgacgaaacatgaagagggagcttatctgacggtgagaaaaaactttcaaaaagcagatgaaaaacccccctacacgtatgcagacggggaaaaagcttttcagaaagtgtctgaacgctatcaaaaagggctggtctatcataaacggacgaagcttgtaatcgtttcagacggggatcaaaagagccgttatgcgtggcttgtcatcatccagccgttcggctcaaatgaacatgacgcatacttggttgatgccgagacagatgaggtgaaacattttgatgacaaatgaagaaaaaaaagcggtgtttatcgatttgtatgagctctatcaagaaagtgaactggaagaggaaacgatgatctggatgaaagagcatgagcagttttttcaggatcaggctgaagcggcagcagccggtaatagagagctccccggcatgcaaaaaacagatgatcatcagaagctccttcatatcaagatttttgtttactcgttatatggtgctttcctgctcctatcgatttggatgacggtgtggttttttttctaaatggctcacaataataaacagacgattgaagaactgtacagggaatattatcatgacatcatgtactatttgtacaggcgaacccatcagcttgagacggcgaaagacctggcgcaggatacgtttctaaaagcttttgcgggcctggagtctttcaggggccattcctcgatcaaaacatggctgtatacgatcgcacatcatacgtttatcaactggtacagaaaagataaaaaaatccaattttccgacgtggcggcctgcggcgatatggaacagcacacatttgaaatgcctgagcgccatttggcaaacgccataatgcaggaagagctgaaacatcacattgaccggctgaaagaagattaccagactgtcctcattttaagagagtttcaagagctgtcatacgaggaaatagcggaagtgctgaattggaaactgtcaaaggtaaaaaccaatcttcaccgggcccgcctggagctgaaaaaaagcttggaaggcagggaggtttaacaatatgaaatgccatcttgtaagagatttactgcctttatacatagaaggcgattgcagccgcaaaacggaacgtttggttgccgcacacattaagacatgcgaggattgccgggaaatgtacgacatgatgagggaacctgtcaattttcatggtgacggaggattgccaaaggaagcagaagaagcggaagaacaaaagttcaggaaagcgtattatcaaaggctgattctcaaaggggcagcgctgtttggcgggggctacttgctgatgcttttgatttacttattctttttataagaactggcggcaaccagccgccggttttttgatataaaatcaaaagccccttcattcggtaggggcttctttcctattcaagcaggcctttttcgcgcattctttttttcagtgtgaaaccgcttcccataatgacgatcagaatcgcgatggcgattgcgacgccggctgcgcttttttcggcgactgcaactccgatcatcatgatgctgatcactgcagcaagtgcgaataataagaaaatccatttgatttgtttcactgtttttccatccccttagtatgaagtctactgttagtttacagaaaatcgcgctggatagaaaggggcaatgggagctgaaaatttgaaacaaattgaaataactttgtttgtcagttataatatgaaagattatctgaatttttttaggagatgaaaatgtgaaacttcgagaagatcttcgcaatatcgctattatcgcccacgttgaccatggaaaaacgacgctggtggatcagctcctccatcaggccggtacattccgtgcaaatgaaaacgtggctgagcgcgccatggattccaatgatttggaaagagagcgcggcattacgattttagcgaaaaatacggcgattaattataaagatacacgcattaatattttggatactccgggacacgcagatttcggcggggaagttgaacggatcatgaaaatggtcgacggcgttctgcttgttgtcgacgcttatgaaggctgcatgccgcaaacccgctttgtgctgaaaaaagcacttgagcaaaacttgacgccgatcgttgttgtcaataagatcgaccgcgattttgcccgtccagaagaggtcgttgacgaagtgctcgatttgtttatcgagctagatgcaaatgaagaacagcttgaattcccggttgtttacgcttctgcgatcaacggcaccgcgtcagcagatccgaagcagcaggatgaaaacatggaggctttattcgaagcgattgtcaaccatattccttgtcctgtcgataaccatgaggagcctttgcagttccaggtggctctgcttgactacaatgattatgtcggccgtatcggaatcggacgcgtgttcagaggaacgatgaaggtcggacagcaagttgctttaatgaagcttgacggttctgtcaagccgttccgcgtcacgaaaatcttcggtttccagggcttgaagagagtcgagattgaagaagcgaaagccggcgaccttgtcgctgtatcaggaatggaagacatcaatgtcggagaaaccgtctgcccgattgagcatcaagaggcgcttccggttcttcgcattgacgaaccgacgcttcaaatgacgtttgcggttaacaacagtccttttgccggtcgcgaaggaaaatatgtcacggccaggaagattgaagagcggcttgaacagcagctgcagacagatgtcagccttcgagtcgatccgacgccatctcctgacgcatggatcgtgtcaggacgcggtgagctgcatttgtcgattttaatcgaaaacatgcgccgcgaaggctttgaactgcaagtatcgaagccggaagtcatcattaaagaaatcgacggcgttcgctgtgagcctgttgaacgcgtacaaatcgatgtgcctgaagagcataccggatctgtaatggaatcaatgggtgcgcgcaaaggtgaaatgatcgacatgatcaataacggaaacgggcaagtccgcctgattttcaatgtcccttcacgcggattaatcggctactcaaccgaattcctttcccttacacgcggtttcgggattttaaatcatacgtttgacagctatcagccggttgagccggggcaagtcggcgggcgccgccaaggcgtgcttgtctcaatggataccgggaaagcttcagcctacggcattcaaggcgttgaagagcgcggcgtgatttttgtcgagccgggcacagaagtatatgaaggcatgatcgtcggcgagcacaaccgtgaaaacgaccttgtcgtcaacatcaacaaaatgaagcagcagacaaacgtgcgctcagcgacgaaagatcagacggtcagcatgaaaaaaccgcgtatcatgtcgcttgaagaatcgcttgaatacttgaacgaggatgagtactgcgaagtcacacctgaatccatcagattgagaaagaaaattctcgacaaaaacgaacgcgaaaaagcagcgaaaaagaaaaagctggcaggattgtcgtaatatttgcagaacctaaaaaaagagcaacccaactaagcaaaggggaggggaatctttttgactgatgtaagtgaacggctgtcgttttttgccgctctctataaagtggaccagaatcccgaggcgggaatgtggtggctttatgccaccatcttcgtcctgtctgcggtcgtctttaaactgggtttcgccaaacggctgccgctgttgaaaacggcgatcatttacttttttctggcattaggctgtacgtttttaacttttttcggcgtttttctgccggttggagaagggctgatcgtagctgttttaatcctttcgatttataaaatccgcctgcaccgttcgaaaaaagagcagacgggggcgaatacgtagaaaagacatagccttcttcggctatgtcttttctgtatccgcgagaaaatccgccgttaataagtcccgaaacaaagccctggcaaaaaggatctcatcagatgaataccggcttaaaaatcgtttaaatctttgttcgattttatcgtgctcccgctggtgaaggtgatggatgcttctccctttatggcttaaacggaagtagatttcttttttattatcgctgagctgtgttttgctgacgagccctttttcggtcagctttgcggtgatccttgagaccgtcgcttttgaaaattccatcttctcggaaatcgaggtgacgttgatcggttcgtggtcgccaatgcagctgatcgtatggatgtcagacatattgagtctcatttcagctccgaattcgcgctccatctttttcatttctgcggagatgcgctctttcatgacggtttcttgctgctcctgctgatgaatgagcctgatgtacaggtcaaatatttcttgtttggcgtgtgttaaatgttccatgcagaaaaccggctcctttaatcgattattctgctttgattataccattttgttacgcgtgaaacaaaatggttaaacagattgcagattaagcgtttccgcaccagcggcggattccatcggcaatcaattgctccgcgttttccagggattcgtccacagcccaggctatgtggccgtcggggcggatcagcgctgcttttacgccattccattcaggccgtccgtcaatcgctttcagttgcataagccggacatgaggcagtctggaaaattccttcggttcttttccgaatgctgctaataagaaacgtccatcgcggtgaaatgtgtaaagtcgtttgacagtaccatctgaaagggtcaggtcaatatcgggcaggcgtttaccgttcagctcatgttcaggcattttttcatctgcatcatactgcacgctgagcgctgcaatttgttctgccagatagcgattgacgtctgaaaatccgagtatgccggatagcaattcacggaggtacagcccttcacgcgtaaaatcaaacagctttgtttggatttgtgtattgacgatcagcgctttgccgacagggtgtctttcatgatggtaactgtcaagcagccagccgggacaccgtccgttgatctttgctgcgagcttccagccaaggttcatcgcatcttgaagcccgacatttaaaccttgtccacctgcgggaaaatgtatatgcgcggcatctccagctaaaaaaattctgccggaacggtaatgctccgccaacttgctggcatttccgaagcgggacatccaaaccgggctgttaattccaaagtccgtaccgcaaatgcggctgagttctttttttaattcttccagtgtgacgggctcgtgaagcaaagcttggggcatatgcggcgccgttatgaggacgcggaaaatgccgccgtctaaaggcacgatcacaacgccgccttcacggttcacgcaagtatagaaatgcgattccggcggattttcaagcgacacatcaccaagcattgcggtgatattcgcatcagttccggaaaaagcgatgcgcgcctgcttgcggatggtacttccggccccgtcggcaccgacgatataggaagcggttagtaaggacaggccgtccggaccctggacgacaagctcggcggtgtcttcatgctcgcggacagcgagaacttcatgaccgcgaaggatgcagacaccgagattcctcgcgtgttcctcaagcaccttctcagtttcgtactgggggatgaacagtgtaaaattggctcgcgtgtcaagcgcagaaaaatccaatccagtcttcagacctgcaaagtgccccgaaccgagcggcttgccaatttccttaaatcgttctccaagccccctcatttcaagtatttcgattgagcgaggatgcagtgtgagcgcttttgagaatggagaaggctcattcagccgttcgacaatacaggtccggacgccggccaaagccagctcggaagccgtcagcagaccgacggggccgccgcctgcaatcaatacatcaaaatccatgatcaatcactccttttttgttgcatatgaaacaattttaaaatactacaaatgaaaatttttatcaactatattctgttattttgttacttatgtaacaaaaagagataaaaaaagcatggagcttgtccatgcttttatgacttgatctgctctttatcttttctgtgcggatataacttaaaacggccggttttcatccggttttcggttttgattttaattctttcgctgcattcatggcacatataggtatgtatcggccggtttcggagacgtttggcaatgagtgtgtcgtcatcgattttttcgattttgtcacacaatgaacactttaccctcacttgattcacctcgcttacgatccattataccttaatcgatctgacaaataaattttctctattagaaaaaaggaaaaagcctgtaccgtcaagaaaacagtggcacaggcttttttaaagttattgctgccgatttttcatatgtttgttcgattgattattctgcttcttttcgagttgtttttggtttctctcattcagctggtcgttgttggattttgtaggatttgtttgctggttgtctgttgcgtcgttcggcacttcaggaaggacgcgcccgacaatggctgccagctcatcgagaatccctttgacaggacgtcccgcttgaatttctctgcccattgcccgcaggcggtttacagtgtcgggatccgcgacaacggcggcgtttgctccataagggtcattctgcagagcttcagcgaccgaatacttaatggattcgactttgctgcgttccaaattgtctttcacatcaattccgacgacggagagcctgcctagcacgacggcggtcgcatcattgacacccggaacgctttcggtgatctttacaaggcgccgtgagatggcttgtccgtcttcgcggttcaccggctcctgggcgctgttttttacatgaatcggtctgttgccgggaagctcatttgcttcatttcgggcattattttgaatgccgcaggctgaaagcagcataacggtttgaattaggatcaaaaaaaagattcgcacttgaggttgcctccttaaaaatgctttcattaatttttattgttgaattaaccttctatctttattcacaaaaacatatattttagcgggcgctccatcagcttttaacccaaatgaaaataaaaggctaaaaatcctgatcaggaggcggaagattgagtaaaatttatgtgctagatacgaatgtgttattgcaggatccgaattcaatcttttcttttgaagataacgaggtcgtcatcccggctgtcgtattggaggaagtcgattcaaagaaacgttacatggatgaaattgggaggaatgcaaggcgcgtatctaaattgatagatgatttgcgtttaaaaggaaagctgtatgaaaatgttcctctccctaacggaggaagcttgagaatcgagcttaaccatcgctcttttcagcagcttcaggaaatctttatcgaaaaaactagcgacaaccggattttagccgtagcgaaaaacctcagccttgaagaagaaacgaaagaaggcggcagaccggttattcttgtcagcaaagatatgctgatccgcgtcaaagccgatgccatcgggttgatgtcagaggattttttgcacgacagggttgtcgacaatgatgatatatacagcggttatacggacgtgtacattcgctcggatcagatgaattcattttttgaacatcattatttgcagcttgacgaaatcagcgaggagccgctgtgtccgaaccagtttgtcgtcatgaaggacgcgctcggcggatcatcttctgcggttggaatcgtagatcaaagcggaaaagccgttaaaaagcttgtttttgaccaggagcaggtttggggcatccgttcccgaaacgtacagcagacgatggcgttggaacttctattaagacaagatattccgcttgtcaccctgatcggaaaagccggcacaggaaaaacactgcttgcgctggcagccggattgctgcagacagaggatctggggaattttaaaaaacttgttgtcacaaggccgatcgttcctgtcggaaaagatctcggctatcttccgggtgaaaaagaagaaaaacttcgaccgtgggtccagcctatttttgataacctggaatacttgttcaatgcaaaaaaaccgggggaacttgatgatattttggcggggatgggctccattcaagtcgaagcccttacttatataaggggcagaagcattcccgaccaattcatcatcattgatgaggcccaaaatctgaccaagcatgaagtcaaaacgcttctgacacgcgtcggggaaggcagcaaaatcgtattgatgggagataccgaacagatcgatcatccttatttggatgcgatgaacaacggcctggcctatgtagtagagcgctttaaagatcaaaaaatttccggaaacgtgaagcttttaaaaggagagcgctcccggcttgcaaggcttgcagcagacctgctgtaaataaaaaaaccgggcttttaacccgggtttcaacttgcatggcacgccggccgggtcgtctgcaaaagccgaaaacccggccgggaaaagaagaggcggagttttttccccgcctccggcgcacccgttacagtgttgccgctttaaataatgtgaatttcttttactcgtttcacaggattcatcttgttagaaccgtcgggaaaataaacgtgtacaggcccgtcttcgccaagcggcttgcctttgttgctgaagcagagaatcatgccgcccgcttcttcaattggaacggaaacgtcttcaccttccgttttgaagaggcatttgacggcggagcctgacacctccgcgtttttcaaaaaaggctcaagcttgattccgaaagtgccgtcaagcaatttttccttttcatactttttctctgatttcagcgtcggcggcgatacagcaccttctctgatttgccgttcccggtcaatcacaaggtcgtcatcttcatcctgtacctctccgaaatgtgaaaagaactgctcgagatcgaattttcggtcatcaaaaatccagacgctcggatcgagcgtaatcggatactttacatttcctgtgatcgttacaatgctcatgtctctaccactccctcacaaaaaattataagcgctttctttcgaattgtcacttctcataacaaaagccctctcggggaaagataacagcaatgacgctcggatggagggaaaaaacttgaattgccggcataataaggagctcgaatattttgtcacagaagcgaaaaaagtgacggacaaaggaaaggttgcatcttacataccggctttggccgaattatcggaggacgatttatcggcggcggtctactttaccgacgggacttgtatatcagcgggggatgtggaaaaagcattcactctgcaaagcatatcaaaagtattgtcgcttgccctcgttctgatcgatcacggaccggaaaaagtgtttcattacgtaggacaagagccgactggcgatccgtttaactccatcatcaagcttgaaaccgtcaacccggggaagccgctgaatccgatgataaacgcaggagcattggtggtcacaagcatgattaaaggagagacgaacgctgataagatcgggagactgcttgattttattaaaaaacttgcaaacaaccggagcattaccgtttgcgggaaggtcgccgaatctgaatttgaaacctcgatggtcaacagggcgatgtgctattacatgaaagagcacggcatttttcaggctgaggttgaggatgttatggatgtatatacaaaacagtgcgccattgaaatgaacagcctggacctggcaaaaatcggctctgtttttgctttgaacggcaagcatcccgaaacgggagaacaaatcataccgaaggatatcgcgagaatttgcaagacatttatggtgacatgcggaatgtataatgccagcggcgaattcgcaatcaaaatcggaattcccgccaaaagcggggtttcagggggcatcatggggctatccccataccgtttcggcatcggcatcttcgggccttcgctcgatgaaaagggaaacagcattgccggaatccggcttttagagctattatctgcgaattacagcttaagcattttttaaaacgttagcggaagcttaaaaagcgagtctttgaaatacggcgaaaggacagaaatagcttgctttttttcggctgaggctttatcataaatagaagaattaggtactcgcctggggaacggagggatacttttggcgtctgagattgtagtcgaccatcgtgaaaaagcacttgctctgttaaaacgtgatgctgataaaatcttaaagctgattcaagtgcaaatggacaacttaacgatgcctcaatgtcctctttatgaagaggttttagatacacaaatgttcggactctctagagaaattgattttgctgtccgccttggattagtggatgaagaagagggtaaagaactgctttacaggctggagcgtgaattgtctgcattacatgatgcatttacaaaaaaataaaagaacacctcagcagaatctttctgtctgagtcagcttgtcgacgacgtttcgatagaaacaatctgccggcaggctttttttattatggaatgagaaagaaaacgccagttgatgaaggaatggccgctgttcacgccgaataaacgaagacgcatgatttgccgataaaaaaatagaatggcagtcttggaacagacggacttttctttctgaggagattcgaagtcttatgaaaagggtatctttcgtgctttttaagaaagtgtagtaaaataacgaaggaactaccacaaacacattttgaaggcaagtaaggaagaggataatatgataaaaagaatgctcaaatcctatgattattcattaatcttcgctgtattcctgctgtgcgggttcgggctcgtcatggtgtacagttcaagcatgatcacggccgtgacaaggtacggacaaaacagcagctacttttttgacaggcagctgatgtttttggcgctcggaaccgtcatatttttatgcgcggcgctttttccgtataaggcttttgccaatcaaaaattccaaaagtttttgctgctcatttccgtcgtcgctttgttcgggctgtttgttgtcggacatgtggccgggaatgcccaaagctggttcagggtttcgaattacggcatccagccgggggagtttgtcaagctgaccgtcatcttgtatctttcttccgtctacgccaaaaagcaaagctatattgacaacttgggagccggaatcgcccctcctgcgatcatcacgctcttcatttgcgccttggtcgctgctcagccggatgtgggaacggcctttatcatcgctttaatcgcattgtgcatcattttgtgctcgggattcagcggcaaaacgctgttaaagctcgtgcttttggccgggattgtccttgtgctcgtcagcccgctcatttatttcaactgggacagcattttaacagaaggacggatgaagcggtttgaaagctatcaaaacccgtttaaagatgcgggagattcgggctttcaagtcgtcaactcctacttggcgatcggttccgggggactgttcggcctgggcctcggcgagagcgtccagaagtatgggtatctgcctgaaacgcacaccgattttattatggcgatcatcgccgaggagctcggtattttcggtgtcctttttgtcgtgctgctgctttctttcatcgttttaaaagggttttatatagcgaggaaatgcgatgatccgtttggaagcctgctcgcgatcggcatatcgagcatgatcgccatccagtctttcgtgaacctgggcggcatatccggcttgattcctttgacaggggtgacgcttccgtttatcagctacggagggtcatcgctcattctgctgatggcaagcgcggggatattggtgaacatcagcatgtttaatgaatattttgatcggttcaaacgaaaacagcctgtcaatactacaaaaacgaaagaaaatcaatataaaaaaagtataaatttttaaaaaactaagcgtgtacaatgaccatccgattcatttagaatagatacatacttataacagcggatgagggggaacgacatgtcacaacagtctattcaaaaagttcttgttgcaaacagaggggaaatcgctatccgcgtatttcgggcctgcacagaactgaatatccgtacggtagcgatctattctaaagaagacagcggatcttaccacagatacaaagccgatgaagcatacctggtcggcgaagggaaaaagccgattgacgcttatcttgatattgaaggcatcatcgagattgcaaaacgcaaccatgtggatgccatccatccaggctacggcttcctgtcggaaaacattcagtttgctaagcggtgtgaagaggaaggcatcatctttatcggaccgacctccgagcacctcgatatgtttggagacaaagtaaaagcccgcgaacaagctgaaaaagctggaattcgggtcataccggggagcgacggaccagtggcggatatagcggaagtgaaacaatttgcggaaaagttcggatatccgtttatcattaaagcgtcgcttggcggcggcgggcgcggcatgcggatcgtcagggacgaatcggagctggaggagtcctataatagggcgaaatcagaggcgaaagcggcctttggcaatgatgaagtttatgtcgaaaagctgattgaaaagccgaagcacattgaagttcaagtcatcggagataaagaagggaacgtggttcacctttacgaccgcgactgctctgtgcaaaggcgtcatcaaaaggtcatcgaagtggcgccgagcgtttcgctttctgaatccctccgggaaaagatttgcgatgctgccgttaagcttgcgaagaatgttgactatgtcaatgccggtacagtcgaatttttagttgcgaacgatgagtttttctttattgaagtgaacccgcgtgttcaggtggagcataccattacggaaatggtaacgggcgtcgatatcgttcagacgcaaatcctgatcgctgccggtctcagtctggacagcagcgaaatcagcattccgaaccaggatgcgatcacgctgcacggatatgcgatccagtcaagggttacgactgaagatccgtcaaacaatttcatgcctgacacaggcaaaatcatggcatatcgctcaggcggcggtttcggggtgaggcttgataccggaaacagttttcagggcgctgtcattacgccttattacgattcgctgcttgttaagctttcaacttgggcgctgacgtttgaacaggcggcagccaaaatggtccgcaaccttcaggaattcaggatcaggggaatcaaaacgaacattcctttccttgaaaatgtggcgaaacacgaaaagtttcttacagggcaatacgacacgtcttttatcgatacaacgccagaactttttgtctttcctaagcagagagaccgcggaacgaaaatgctgacatatattgggaacgtaacggtcaacggcttcccgggcatcgataaaaagaagaagcccgagtttgataagccgcagatcgtcaaaacagatgtcgatcagccaatcgcaagcggaacaaaacagattcttgatgaacgcggagccgaagggctcgtcaaatgggtgaaagatcaagaggaagtgctcctcactgatacgacgttccgcgacgcccatcagtcattgcttgcgacaagagtcagaacgcatgagctgaaaaaaatcgccaatccgacggctgcgctctggccagagcttttcagtcttgaaatgtggggcggcgccacatttgatgtcgcttaccgtttcttgaaagaagatccgtggaaaaggctcgaggagctgcggaaggaaattccgaatacgatgtttcaaatgcttttgagatcttcgaatgccgtcgggtatacaaactaccctgacaacctgattaaaaagttcgtcagcgaatcggctgcggccggaatcgatgtattccgcatttttgacagcttgaactgggttaaagggatgacgctcgccattgatgcagtgcgcgagtcaggcaagcttgccgaagcggcgatctgctatacaggggacattctcgatccgaacagaagcaagtataatcttgaatattatacgtcaatggcaaaagagcttgaagctgcgggggcgcatattctcggcattaaggatatggccggcctgctgagacctcaagcggcatacgaactggtgtcggctttgaaagagacgatcgacattccgatccacttgcatacacacgacacgagcggcaacggtatttttatgtatgcgaaggcgatagaagcaggcgtcgacatcgtcgacgtagcggtcagctcgatggcgggtctgacatcacagccaagcgcaagctcgctttaccatgcgcttgaaggagataaacgccgtccgcagttcaatgtcgatgcggtagagtcgttgtctcaatattgggagtctgtcagaaaatattacagcgagtttgagagcggcatgattgcgcctcataccgaaatttacaagcatgaaatgcctggcggccaatacagcaaccttcagcagcaggctaagggagtcggcctcggcgaccgctggaatgaagtgaaagaaatgtacagccgggtcaaccacctgttcggggacatcgtaaaggttacgccgtcatctaaagtcgtcggggatatggcgctttacatggtgcaaaataacctgacggaagatgatatttacgaaaggggagaatctctcgattttcctgactcggttgtcgagctttttaaagggtatatcggtcagcctcacggcggattccctgagaaattgcaaaagctgattttaaaagggcaggagccgattacagtacgccctggagaactgcttgaaccggtttcatttgacgctataaaagcggaattcttggaaaagcatggtatggagctttccgaccaggatgctgttgcatatgcgctttatccgaaagtgtttaccgagtatgtcaagacagcggaactgtacggggatatctctgtgcttgatacaccaaccttcctctacggcatgaccctcggcgaagaaatcgaggtcgagattgaaagagggaaaacgctgatcgtcaaacttgtctctatcggggaaccgcgtccggatgcgacgagagtcgtttattttgaactgaacggccagcctcgcgaagtggtcattaaagacgaaagcattaaatcgtccgttcatcaaaaggtgaaagccgaccgttcaaacccgaatcatatcgcggcatctatgccgggaacggtaatcaagcttcttgtaagcaaaggggaccaagtgaagaagggcgatcatttgatgatcaatgaagcgatgaaaatggaaacgaccgttcaggctccgttttcaggaactgttgaaaacattcacgttacaaacggagaagccattcaaaccggcgaccttctcattgaactgaaaaaataaaagcacggccgctgacttttgtcggcggcctctttttatgaaaaaatcccccccaaaaggcggaggatcaaccgtttatttttatttttgcacctgcctgcgatagcgcgcaacaagcagcaggaagtagcaaaggattccgaacaggcaggaaataaagaatgcgtgggcgagtgcaaaacccaaatccagtctgctgtagacaaccgcaattcctgaggcagcctgaaggatgatcaggatcagggaaatcatccagccccaataaatgcgtttttgatttttatactgtcttgctgcatgtaccgctgccgcgatgatccaggcgaacagaagaagcgccgcagctctgtgtcccatctgcacccattcgtgaaacttcccgggaagccagccgttttccgtgctgcacatcggaaagtcaaggcacgcgaggctggaactcgtatgccggacatatgcgcctgtataaacgacgacatatgtgtatataatgattcctatcatatgaaactgcatggtttttcctatataaaacgattcggatttctgtttgctgtcagcttcaaacaccaggagcgtcaaaagcagcacagaagcaaaggaaataagcgagattccgaagtgcaaagccatgatcagggccgatgacccgaagacgaccgctgcagcgcccaaaagcgcctgaagaatgagaaagacgaccgacatcaccgcgagaaatttcgtttctctgatatggccgatttttttccatgtccaaatggcgagagccagcacaaggacgccggatgtgccgctgacaaacctgtggctccattcgataatcgattcaagggttaaagccgggaatatgcttccgttgcaaagcggccaagatctgccgcagcccattcctgaacccgtctttgtgacgagggcgccgccgatcagcacgaaaagcatggcgatagttgtgataattcccaagccttttaatgctttattcataaattcaattctcctttttaatgcaaactgactaataaaaagatatttaccaccttcaagtgtaagcgaattgatgttctgctgcaattcataatgattattgttcacaaaaatgcaatagaaggcgttcacatttttattggttttgaagacttgataattgtggcttcgtttgatagaactatattagaatgacagtggttttccgctcttgttcacaacttttccttcatctgtaaagaaagtcataaaaagttcacaaatataaaccggtttgtcgattaatatttaataggctgtttttttccatccggtaatcttgtatgatagagttgtaggttttttatgaatataccgcttctcttgacgtgatgaaggtttgagtaaggggggttagtattatggctgaaacaagaattacagctgatacagcaatgaatggacaaatagaagagacgacagcatggaaagatttcctcgcccttatcaaagtcgggattgtttactcgaacctgataacaacttttacgggcatgtggctcgctttttacttttcaaatctgagctttctaggaaaccttgatatcgtgctgttcactttagcggggtcctcgcttattattgcaggctcatgcgtcatcaacaacttttatgaccgtgatattgaccagctcatgcagcggacgagaacaaggccgacggtgactggaaaaatccagccttcacaggcattgtggttcggcattctgctgactgcgctcggttttatcatgctgctgatgaccaatctgacagctgccgcagtaggatttgtcggcgtctttacgtacgtgtttctatacacgatgtggtcaaagcgccgctataccgttaatacgatcatcggaagtgtgtcaggggctgttccacctttgatcggatggaccgctgtccaaggttccatcggagtcgaggcgtgggtgctgtttttaattatgtttatttggcagattccccactttctggcgcttgcgattaagaaaacggaggaatacagagccgcaaatataccgatgctgcctgttgtacacggttttgaagtgacgaaaaggcagatcatcatttggattgcctgcttaatgccgctgccgtttttcctgggcggactcggactgccgatcgtcattttggggacggtgcttaatatcggctggctcgtttgcggtctggtcggttacagaagcaaaaatatcatgaagtgggcaacgctcatgtttgtatattcattaaattacttgaccattttcttcgttgccatggtcgtatttacactttttaaaattggatagaactctataattcatcacattgaaggctgtcaattaacacttcaagcagacaacaatcatgtaaaagccgccttatcgattttttcgattatgtttaacaaggcggctttacgttcatacatagatggtattttgagtaaaaaacctcattatttatgaaatgaggaaatgtaagtgctttaattggagtggggagtcagatgaatgaataggtgtcctataaacgtttgaacagtgaaagtttcaaaaggattgattgaaaaggggttgggaagaaatgttaaagaaatggcgtctgatgtcgctgttcactattttggcgcttgttttagcagggtgcggagaaccgtttatatcaacgctgcagccggcgggcgaggtggctgatcagcagtatttcctaatgattctcagcacgctgatcatggttgttgttgtagtagtggtaagtttcattttcgtatttgtcatcgtcaagtacagaagatctaagctcggtgatgaccacatcccgaaacaggttgaaggaaaccgcaatttagaaattttatggactgttattccgattatcctccttcttatcctggttgttcctgttgtcgcacagacctttgatcttgctgatacgaaaccgatggataagaaaaacagggatccggagaagacgctcgtcgtcaacgtgcgggcgaacctttactggtgggaattcgaatatcctgactacggcgtgattacgagccaggagctggtcgtgccgaccgatgaacgcatttacttcaagctgaaagcttccgatgtcaaacattcattctggattccttctgtcgggggcaaggttgatacgaacacagacaatgaaaacaagttctacttaacgattgattcaaaacgggcggaaaaagccggagactatttctacgggaaatgcgccgagctctgcggaccttcccacgctttaatggactttaaagttaaagcggtttcgaaggatgagttcaagaaatggatgagcgatatggaaaacaataaagcggaagcgaaaaccgatctcgctgttgaaggagaaaaggtgttcaaagagaaaaactgcctgagctgtcatgcgaccgattcaaaagaccaaagggcggaagcggccagaacggctccgaacctcgcgacttttggagacaggtcgacgatcgccggcgtgaaggaattcaacgatgaaaacttgaaagcgtggctcaaggatcctgaaagcataaaaccgggcaacaaaatgaccggcacataccctgatttgagcgacaaggaacttgatgcactgactgaatatttaaaggggttaaaaaccgaagactaacgcttcaaagggagaatgagggaggttacattgtgagtacgcttaagaaaaagcaaggttttggggctgtattatgggactatttaacgactgtcgatcataaaaagattgccatcctttatttgctgggcggcgggttcttctttgtgctcggcggaatcgaagcgatgctgatcagggttcagctgatgataccgaacaatgacatcatgagcggcggggtctacaatgaaatcatgacgatgcacggcacaacgatgattttcctggcggcgatgccgctgttgttcgcattgatgaacgccgtcgttccgctgcagataggcgcgcgggatgtcgcgtttccattcttgaactcgctcggcttctggctgtttcttttcggcggcatctttctgaatttaagctggtttttgggaggggcacccgatgccggctggacgtcttatgcgtcgctttcccttcattccgaagggcacgggatcgatttctatgttctcggtctgcaaattgccgggatcggtacgctgattgccgggattaactttctcgcgacgatcatcaacatgagggcgccgggcatgacatacatgaggctgccgcttttcacatggacgacattcgtcgcttcggctttgattttgttcgcgtttccgccgctgaccgtaggcattgcgctcttgatgctggaccggttgttcggaacgagctttttcaatccggaattaggcggaaatacgatcatttgggagcatctgttctggattttcggacaccctgaagtttatattctcgtactcccggcgttcggcattttttcggaaatcattccggtttttgcgagaaaaaggctgttcggctattcttcaatggtatttgcaaccgtattgatcggctttttaggcttcatggtttgggctcaccatatgtttacaacgggactcgggcctgtggcaaacgccatttttgcggtggcgacgatggccattgccgtcccgactggtattaaaatcttcaactggctgctcacggcgtggggcgggagcatcaagtttacaacgccgatgctttacgcgatatcctttatcccgacgtttgttatgggcggggtgacaggcgtcatgcttgctgccgcaccggctgactatcagttccatgacacgtactttgtcgtggcccacttccattacgtcatcattggcggagtggtgttcgccatcctcgccggagctcattactggtggccgaaaatgttcgggaaaatgctgagcgaagcgttgggcaaaataacgtttgtactctttttcatcgggttccacctgacgttcttcatccagcattggctcggattgtggggaatgccgagacgcgtgttcacatacttgccgaatcagggatttgacatggcgaacctgatcagttcaatcggagctgtgtttatggcggctgcggtcatcatactcgtgatcaatattatcgtgacgactgccaaaggggaaaaagtcggcagcgatccttggcaagacggaagaacgcttgagtgggccgtttcttcgccgcctcctgaatacaacttcaaacagctgcctttggtcagaggccttgatgctttatggatcgaaaaaagagccggcaagcagtcaatgaccgccgcggagccgcttcaggacatccatatgccaaacggatcgattcttccgttcatcatgtcactcgggctgtttatatccgccttcggctttatgtaccggacggaatttgcctgggggctgcctgtcattctgatcgggttagggatcacgttatttatgatgcttctccggtctgtaattgatgaccacgggtaccatattcataaagaagatctgatggatgatgacgacaaaggggtgaaggcataatgcatacagaagagaaattgacggctgaaaccttcccggcttctcctgaaaaagctacgttagaaggaaaaaataaatttatcggcttttggctatttctcgggggagagacggttcttttcgcgtctctcttcgcaacataccttgcgctgaagaattcgaatgcaggggggccgaaaacgaccgagatgttcgacatggggctggtctttcttgcgacaatgctccttttgacgagcagtttgacgagcgtgtatgcgatgtatcatatgaaaaacttcgcttttaaaaagatgcaggtttggctcggaatcaccgttctgctcggtgcaggctttctggcgcttgaaatatatgagttcacgcattacattcacgaatatgggttcaccattcaaagctcggctctcggctccgctttttatacgcttgtcggcacacacggagcacacgttaccttcgggcttctctggattctttctttgatgatcagaaatgcgggccgcggattaagcctttacaacgcgccgaagttttttgtcgcaagcctctactggcattttatcgacgttgtctgggtgtttatctttaccgttgtatacttgatggggatggtgggataaaaatggtgaataacgaaaacagagggaatcccaaaacagatcttgcctaccgcaaaaagaaaaacgcggaggacatgagatatcaggttatttcattcggtttgatgatcggcctgaccattgtcgcttttttaacggtcgcctcagatgccggcgtatggtttacggtgccgtttattctgctgctcgccgtcattcaggttgcgtttcagctgtattactttatgcatatgagtcagcgggggcatgaagcgccgactttgttcctttattcgggcgttttggtcgcttttgttaccgtgttggcttttgtaacgctaatctggtggtaatcgaaccgacatacagaaaggaggatgctcatgttgggcagccttgaaatattcggttttcgcgccctttggagcccctatttcctaggggctgtcgttttcataaccgccctttacttttttctgatgaaacgcttaggatcagaaggagagcgggcgtccaggaaagaaatcggtttattcctgacggcgatgattcttttatacgcgtctaagggcagtccggttgatttgctgggacatattatgttcagcgcgcatatggcgcaaatggcggttctgtatttgatcgtgccgcctctgatcatccttggcataccgccttggttttggaaaaaggtcatttttctgccgatcgtcaagccgctgttccggtttttttccaaaccattgatcgcgataatcgtgtttaacggtctattttcgatgtatcacattccattggtgtttgattttataaagacggatgccgtttatcatgccgccattaccgtgctgatctttattgcagcgtttttcatgtggtggccgctcgttcacaaggtcgaggagcttccgcagatgagcggacttttgaaactcggctacattatggctgacggcattttgctgacaccggcgtgcgcgttaatcatgttcagcgatacggctctgtattcgacatattcggatccgtcagcatgggcggaggcaatgaagctgtgcgttcctctcgatacgctgagcggaatgacgcttacaggtccggaaatgttcagcagcatgcctgttctcgaagatcagcagcttggcgcgattgtcatgaaaatcctacaggaaatcgtgtacgggacatttttggcgattatctttttcggctgggcgaggaaggaaagagccaaagacgaaaaggacctggaagaagaatcatattctccgtctacggttcattaaggtcaaaaaagggtacagcctcaccgaggggctgcacccttttttatgtacgcctgctacacttcaagcgctgaaaccttttctttgatcgaattcagcaccgtcttgcttgttttgaggagctgcggcggaaaatgttcgtcttcgccgtattccactccatgcggataataatatttgcccaaaagcggcgtcatcagtttgattaccgcgcgccgggcgcccacgtcaccttcgatggcatatccgaacacgcgaaggtagaatcttccttcgaccatatcgaatttgcggtcatatgtgacgcgttcataatcccattgtccagctcttacgaacccttcgttttccatgatgtcgtctaaccggttaaggtcggcagtcaatccttcaattccggattcttcaaatttcatcccgtaaaacccccttaaaaaaattacctttactgacaatcatagtatgaaagcgttaaactttcaatcctgcctgagccgatatataaatatttttgtggacagtatgaatcgcgcgcggcttgacgacaatatgaacaaacgaacgacaagaggaggtcttctgattgacacgtgtgaaagatatcatgacaaaggaaacattatattgtacggttcttgataatgtatacgaggctgccgtgaaaatgaaagacggggatgtgggagcgattccggttgtgcttgatgacggcttggaactggttgggatcgtcactgaccgggatttagtgctgcggggaatcgcagctaaaaaaccgaattcgcaaaaaattacaaatgtcatgacgactgatctcattacggtaagtgaagacgattcaattgaaaaagcggtcgatctcatgggagattatcagatcagaagggtcccggttacacggggaaaaacgcttgccggcatcattacgctcggcgatgtttcaactcacaataaatcgaaccgccaggctggcgacgcgctgacatttatatctgaaaacgaagagcggcctggagattttcttcattaaaacatattttgtctcacatcttaataggctgtattaacattgaaaattcatgtcagttctgtttaaatgacactaaaggcaagtttttgatgcgtgcgcagcttaatggatagattgatccgtcagtcggaggtgaaagtttgaaaaatatattaagagcggtcgtgatccttctcatcgttgcggcttcatacacgctgtttattcaatacggctcaacgcctgagaaaattgcgaaggaagacaagccgcaagtctcaaacgaagatgcaaaaaaagagaagcccttgaacattcccgattccggcctgctttcctttatcggggaatcggccgagacgatcgaaaagaaactggggaaaccggacagagtcgatccttcagcgtatgattatgaatggtgggtctataaccaagggaaaaaacagtacgttcaaatcggcttgctgggcggcaaggctgtgacattgtttgcgacaggcgacggggtgaacaccgctccgtttaaaatcggacggccgtcaagggaagttttcaaaacgacccagatcgccccgtatgtcaatgttcaatataaaggcagttcataccgttttgagttttccgaggaagatatgaatacaaggccgacggttaaagtcggaggcatctatgttcagctgtacatggataaattcgaggggacgctttcaagcatcagggcatttgatgcgccgactttaatcaagcaaaggccgtatgaagttgtctacagaggcaccctgatcgagcctaaagcattgacagaatcggattggaagaaaatcgagaaagcaaatgagaagcagatttttgatataacaaacgttatccgcgcaaggcacggcctgtctgagctcacttgggatgaaggcgtatcaaaagtggcttacggccacagcagcgacatgaaagagcaccattacttctcccatgtgtcagaaacggaaggcaccctcaaagacaggcttgaaaaaggaaaagtcaattttgagcaggcgggggaaaatatcgcgctcaactatgtcgacggacctgcggcggttgaaggctggttaaacagcgaagggcacagaaaagcgctcttaaatgccgactatacccatctcggcgtcggggtggatgagaaatattatacgcaaaactttattaaagaatggcaatagagcccgggacaatacccgggcttttcgttttttgagaaatcctgaaatgtcggctgctcaccgttcctgtaaaaagaggaattttaggcgaacattttttgccggggcggattacactatagtaggcatatgttttcggagggggtgtagacgttggcaaatcaaaacgcgcaatcatccatcaatgaatttaagcaatttataaaacggcatcctaagttgatttccgaagtccggaaacaagaaaaaagctggcaggaagtctatgaaaactgggttttgctcggggaagacgattcgatatgggatccgtacagggaagaagcttcagcggaaaaggagccggacgctggcggcaaaaacgatttcatttcgaaaatggtgacggccgttcgaaagatggatgccaatcaaatgaatgagcagatcaataaaatgagccagtctatttcttcgctgcaaagcttgctcagccagttttcgggcggaagccaaaaacagcagaaacaaagcggcggcgagcatccgttttctttccgaaaagattagggaaggagaaagacatgcgtaaagaagtgcaggagtatgtgttcgccgacgaagagcgccgccggttcatccgtgagcagccggtctggtaccgcaagctttcgcggaatccgaatgatctgtcagcctttcatctcgatatgatgaatttttatgaaaaaacgattcctcacagggtcaaccagttatcgggcagcattcagatggcccagatgatgctgcaaatgtttcatgcgatgcgcactcaggattaatttaagcctgagtctttttttgtgatgataaatcgcgccattctggtaaagctaggtgtgaaggagttgatctgtgatgaagaagtgctggcttgtaatctttctgtgcctcttgctggccggctgcgccacccataaaccaaagcccaaaggcttatctgattggcgcgattccgcttgtgaaagcgaagtttttggaaaattatagttcggaggcggcatagacatttttgaaaacggctgttttgtgatacactatagctggaggtgcatgtctatgtttgccacaatggaatcgttgcggcttcaaaatgaagcatatgatttggccaacatgattcttcaatcagaggcggctgaacattacagaaaatgctacaagcgtctccgcgaagatgaagaggccggacgtattatcgcttcgtttacgaaaataaaagaacagtacgaggatgtgcagcgctttggcaagtatcatcctgattataaagagatatccaagaaaatgagggaaatcaaacgggagcttgaccttcacgatacagtagccgaatttaaaaaggcggaaacagagctgcaatccattcttgatgaagtcagcgtggaaatcggtcatgctgtgtcaaaacatatcaaagtaccgactggaaacccttattttgataatctttcatcttgcggcggcggctgcgggtcaggcggaagctgcggctgtaaagtttcctgatgaggctcggtcgccccgagtctcgtttttttatagaacttcatgcacagagcgacaggcaggtgaacaatttggaaatcaggcgtcaaggcttaatcgtttggctgcactccttgaagcaggcgaaaatgctcaggaaattcggaaatgttcattacgtttcaaagcggctgaaatatgtagtggtgtattgcaatatggaagatgccgaaagaatcatcgcaaaaatacgttcgtactcttttgtcaaacaggtggatctttcatacaaaccgtttttgaaaatggagtttgaatccaagcaggataaagcgaaagaatacgactataaagccgggctctaacttggtttatgttaaaaaaatccccgcagaaatacctctgcggggtccttctattccttaaaaaattaaggagaaggcaaagggagaggagaaaccggaggaagaacttatggggaaacgtaagtcttctccgcggttggcaacaacatcaatcgatgctgttgctattattatcaccaccgagcctttttgctatacatatgaatttgcactttgggtgtttgtgccagaaaacactttatgataagataggaatgatttttttcgagttttaagaaaaagtggtggaagtatgagagtgatttctgggacgtataagggacgtgccttaaaggcggttcccggcacgtcgacaaggccgacgaccgataaagtaaaggaatccatctttaatatggtcggcccgtattttgaaggcggcaccggccttgatctgtacgcgggaagcggcggattgggcattgaagcgctgtcgcggggatttgaccgcttcatttttgtcgaccgggattttaaagcgattcaaaccgtgaaaggaaatttgaaaacgctgggcttagaaaagtgcgccgaagtgtacagaaatgacgcagaacgggctctgcatgcactggtgaaaaggggcgcaagctttgatgccgtctttttggacccgccatatcgagagcaaaagctggaagcgcttttatcgatcattgatgaagcggatatgctgactgaaagagggtttattgtggctgagcatgcgaaggaagtcatgctgccggatgcggcgggcggacttcagcttgcccggcaggaaatatacggcttaacaggcgtgaccatatacagaaagagagggaatggggatggctagcattgccgtttgtcccggaagttttgatccggtgacttttggacatttggatatcatcaggcgcggggcgaaagtgtttgataaagtttatgtatgcgttttgaacaattcttcgaagaagccgctgtttacagtggaagaacgctgtgggctgcttcgcgaagtgacgcaggatatcccgaatgtgcaagtggaatcttttcaggggcttttgattgattatgcaaagagcaagcaggcaaacgtcatcctgcgggggcttagagcggtatctgactttgaatacgagatgcagggaacctcgatgaacaaagtgctcgatgaaaatattgaaacgttttttatgatgacgaataaccaatactcgttcctcagttcaagcattgtcaaagaagtggcaaaatataaaggttcagtcgcagaactcgtgccggaagcggtcgaggctgcacttgaaaaaaagtttgcaaaaaatgagcggccgtaaccggctgctcattttttaacaggggcgtaagatttggcataaagaatgatatagatgagaagggtgccgattgttaggagcggaccgatctctgctaaagtgttccacatctccagaaagaaaggttccgtcttcccggccgtcagaaaggagaagaccggctcagtcggagaatagaacgatgtgtaaagaggcttccaaagaataagaacaaagatcgctgcataaattccctggaggatgcgagcgataaaaaacggcttaaagcggatatccgtttcagcaagaatgcctgcaacctgcgcttggacgcagaagccgctgaaacccaaaataaagctgacgatcaccgcttgctggagaagcgccgcatccgttgcgctgaccagtttgctgccgagcgtaatctcaaacaatcccgataataaaggcttatcaaaatcaccgggcaattgaagagccgtcaaaatcattcttgtcgcgtgcgaaagaatgtcggtgatgtgcatcacagaaagaatgttattaaaaaccgaaaaaagaatgatgaagccgcccaccattagcagcgtttgaacggaggagatgacagcatcgctcaaaagtttgccgagcggccgcttttcttcaagtcttgcctgatggagcgcttttaaggcttctttaattgaaggcacaggaagcttctttcgcacggcggtgcggttttcttcttttcttccgtaagtgcgcatcgtcagtccaactgcgaaattgcccaaataatgggccgccgcaagcacaacgccaagagaaggattatggaaaaagccgaccgcaacggctccgaaaataaacagcgggttagatgagttggtgaatgaagcgagccgctctgcttcgacccgggaaatctgccgttcctgtctcagccttgaagtcagttttgcgccggccgggtttcccgatgccattcccattgcgagcacgaaccctccgacgccgggtacgcggaacaccggtctcatgaaaggctcgagcaacagcccgacaaacctgacgacaccaaacccgatcaagagctctgataaaataaaaaaaggcaaaagggaagggaatacgacctcccaccacatggcaagtccacttttagaagcgtcaaatgattcttgcgggtgggtaatgacggcagctgtaaatgaaagcagcaaaacggcaatcatgagtgtctttacctttgacatgtccatttctaaccccctttgcggctgtgaatacacattggaaacaggatcatgataaaataaacgaaaagcttgcccgatttgtgcggtagccttctccgtgaaacttctttatcattatacgaaggctggtccttattttagaccaccagattgcagatcggcgatgaaacaaatgaaccggaagctctttaaatgcgcggaaacccttctccttgatgagcatcaaaagaagggcatttcatacatctgtgaattcatgcaggctgaaaattcgaagccggatcaagatgtgagccggtgaaaataaagatggagggttacattttcatgctgaaaaaaagaattatacgcatcgcactattgctcgttatcatcgtggccgcgctgtcatttgtgaagctgccatattacatcaccgaacctggcgaagcgaccgagctgaaccctttaattaaagtcgataacggctatcctgaaaaagggagcttttctttaatgacagttaaagtcggtcctgccaacccgcttacatatatatgggcaaaaatgcgcccttaccacgaaattcttccggaagaaaattttaaacaagaaggcgaatctgatcaggaatatatgaagcgccaactgcaaatgatgagagattcccaggaaaatgcgatgatcgccgcttataagcgggccggaaaagaagtcagctacacgtttaacggcgtatatgccatgtcggtcgtcagcggcatgcctgcagaagggaaaatacaagtcggggacaaaattaaaaaagcggacggaaaatcgttccggtcagcggagagcttcgtccgctacatcgagtcaaaaaaagccggggaccgcgtgaaaatcgtagttgaacgggataaagaagaaaaaacatatgagatgaagctgaaaacattcaaagaagatccaaagagagcggggctcggcgtctccctcatcacagaccgcaatgtcaaggtgaagccggaggtcgatatggatattgaaaacatcggcggcccttcggcagggctgatgatgtcaatggagatctataaccagctgacaaaagaagacgagacgaaaggacaccatattgctggaaccggaacgatcgacgacgaaggcaaagtcggtccgatcggcggcatcagccagaaagtcgttgcggcagacaaggcgggagccgacatcttttttgccccgaacgaaggcggaaaaaaaggatcaaactatgaagaagctgtaaaaacggcaaaagatattaaaaccgatatgaaaatcgtccctgtcgacacgatggatgatgcgattcattatttggaagataaagtgaaaaacacctgatgtccatcaggtgtttttatttgcgcaaaaatatccggctgtcttcgtcatacctgatcggcgaaagggaatattcccgctctgtcagcatcgtccgcaccggctctttgagcggggcgctgtatacttggcccgcttttatgtcaagctggagggaaggatgggaaaacgatcccgtctttgtaataaggggtgcgctcaagctttttttcttttcagccaaataggcctgccctttttttgtcattccgagaagtctgatatatgccggatgtgtttcgtttaacatgcgcttaacgtcggctttcttcgtttttgtgaggatatgggtgttcatgcgctgcagtcttgtccacgtatagcgcttcgttttcaaaagctccatgtattccttaaaagagcctgctttccggatcgcttttttgacgcggtgctcaaggccttcttccacttcgtatatccctttcagctcttctgtatccattgtatgcaggctgtatttcaaaaaggggaaataatcttcaggcgagtgccacatgccgaaagtccgggcgtattcatcgagctcatcgaccgttgtctttggaaggtagaagcggctgtccgcaaggcttcccgtttcaaaaatcgacttgcgtatgctcgtagcgcttgcgattcggtccgcttcagggaatgttgaatcgtgatagcctgaggaccggcgcttgacggtttcgggcttcatgcttaattgcttttgcatgatggctttcacataatggaatccgagaatgttgttcggctttgaaaggtcaacgatgttaccgccttctcttgttacagaccggaacgcttttgccatcgcttgcgggtagctcagcccaaacgctatctgctttctggcttcttcgttgagcctgtcttcgtgctctatcgtgtgtgcggctgtattgagaaatgcctcaatatcgccgtgctcgcttccgaaaaacaaagaagaacaccctaattcatttaaaatcgagacggcgccttcagcaaacgtttccgctttttggacggcgaatatgtaagggagttcaacgacgacatcggcaaaagatgcgagcgccatcttcgtacgcgcccactttgatacgatggcgggttcgccgcgctgcaaaaaggagccgctcataacggcaaccgccacctcgctccgcgtttctgattttgcttcctttatatgatataaatgtccgttatgaaaaggattgtattccacaacaaggccgaccgctttcattttttcacctctcttgcatctcttgaaatagttatgatacatttacacatggaatgtccagacgcctcgcgaaaacagcgtttttcctaagtgtatgaattgttgttcacgatgtcaacgaatgaaaggcgcaggcgcatatctgtaaagaaaaaatattgacaaaaaacatgatgaaagctataatcatgtttgttgctcacttagaggtgatacaatgaaatggacgatacatcagctgaatcaaatgccgaagaaggactttgaatttgatgaaacagttgatttaagcgaactctctcaaagctcggaaatccgcagcatttcaccggtgcgggtgaaagggcgcgcggaaatccgctcaaagcaggctgcatttgattttaccatttcaggcgagatgatcttgccttgctcaagaacgcttgttgatgttcgttatccattcagcatttctacaaaagaactgtttatatttcataagaccgaggaaatggaagatgaagacatccatattgttgaagatgacctcatcgacttgactccggtcgtgaaagaagaaatccttcttgagatccctatgcaaatcttttgtgagtctgttcaaaaagaagaaggtgctccgcaggagggcaaggattggcaggtcattacagaagatgaccggaaagaccggatcgatccgagacttgccggactcgggaagctcttaaaacaagaagatgaatcttaacgctctttaaggaggtgggaataatggctgtaccttttagaagaacttctaaaacgaaaaaaagacttcgtcgtacacactttaaattgcaagtgcctggtatggtagaatgcccaaactgcggtgagatgaaactttcacaccgcgtctgcaaagcatgtggatcatacaaaggaaaagacgtaaaaagcaactaatcgtcaacaatgaaaacacaagacttcatgtcttgtgtttttttatacccgttttcccttcatccttttatttcctgtaaagaaaatagtctatctactctatcagccgcatatgtatgaggtaaattcataaagtcatggagggggataacatttgacgattacaagacaggatgcatggacacaggatgaagatatattgctggctgaggtcgtattaaggcacattcgggaaggcgggacacagctttcagcctttgaagaagtgggcaaggctttaagcagaaccgcggccgcctgcggattccgctggaattcatttgtcagaaagcaataccaatcaggcattgaactggcaaagaagcagcgcaaagagctgcgcaaaaaaatcggtatccattccgcaaaccttcctggatctgtcaaaacggtttctgagagcaaggcggaaaacctgacgctcgatgatgtcatagagtacttggaaaagctgaaagaagccccggttcaaaaggactttatcgacgagaagaaaaagcttgctgaagaaatcaatgagctgaaacaagaagttgaaaagctgcgaagcgaaaatcaatcgctgaaaaaaaagcttgaattgacagaagaggattataaagcgctgattgaaatcatggagagagccagaaaaatggtcgttcttcagggagacgaacgaaacaaaaaggcgatgctccagccggagccgaatgaaaatctgggggaagcttgaaaatagaaaaccggccatccgctatcggccggcttttttcgtttatgctgattcagaactttgactaggttcgctcgcaggatgccaaacgagcggattttcccctttatcccgggccatatcgtatttaaccggtgtaaagcccatcttgttccaaaaatcggatgatttgacgcgcggacttgtgcgaatcgggagtccgaaagatttggcgaactccacaagcatcgttccgtagccgtttcgctgataccccggcaaaacttcaagcttccagagctcgaggtaatcttggccttcttcaaaatattggtttgatttaccatccactttatacaggctcattcttgcgacgagccgatttccgtaatagatgccgtaaaacggtgagttgctgtcgttttcaatcatgttgctttcaaggtcctccagcatggaaagctcttgaatcccgtactccctgaactttttaaattcttcaagcgttttgtagttgatcagcaaacgttcgactttgaccattatgttacccccttgtttgtggtctacttctattgtaaacgcttttttcaaaaaatccaaatgataaaaattttctaatataatgaagcgaaacggttctgaatatttgaaacaactgacaagtcaacggcgaaaatttctgctatgatatacagtatatgaaaaaatcagggtgtgagaatgtgaaaatcggagtcatcggaggaggctcggtcggcctcctttttgcatactatttttcgttcggccacgaagtgactgtgattgcgcggagaaaggaacaggcggaagcgattgaagaaaagggaatccgccttcttgaagacgggaaagagatgaccgtgaacgccaggggcgtgactgaacttgatccggactgcgaccttctttttgttgccgtaaaggagcatcagctcggagccgttctgtctgagctggagcaggcggctcctcttgacatcatgttcctgcaaaatggaatggcgcatattcccgtgcttgaaaaatggcagacgggccaccgcatctatacgggatctgtggagcacggagctgtcagggtggatgaccgcacattccggcacacgggaaaaggggccgtaaaatggagcgcgttccgaagccaatccgccgcccggctgaaaaaagagctcgcttcggtgcatgaagcgttcccttttatttggtccgaagactggtataagcccctcgccgaaaaattgattgtcaatgcgtgcatcaatccgctgacggctcttttgcgggtgaaaaacggcgcgctgcttgaggagccgatgtatggggcctatatgaagttcgtctttgaagaagcgagccggattttggaacttgaagatcgccaggcagcgtgggaccatgttctttccgtctgccgccggacgaaaagcaacacgtcctcaatgcttgccgatgtgctggcagaaagaaaaacggaagcggatgcgatcatcggctatctgctgaagcgggcaaaagagtcaggagagcccgccccgcaccttacctttttatatcgcagcatcaaggcgcttgaaaacgaatgaagctaaatcttttgaccgaatcgcgtaacgtgctatactcgtttcggatagctaactatttactggagaaaggaagttctagagatgcagcttactgaactttccatacaaagtcaaaacccttttgtacgagactatataaatggaaaaaaggagatagagccgttttttgattacggcctgagcaatgaaagttggagtgtccgtttggatgacctttcctcccggacgtatgaccgcgatgcgttagcagactatttgctcgactatcaccgcaaatttcaatcggcaaccatgaatgaaacaatcgaacgccttcgcgatccgaaaagcgtcgtcgttgtcggagggcagcaggccggccttttaacgggtcctctttacactatacataaaatcgtatcgatccttttattagcaaagcaaaaagaacaagagctgaacgttccggtcattccggtattctgggttgcgggggaagaccatgatctggaagaaatcaatcacgtctacatttctgacggcggcaaggtgaaaaagcacaagctcccgcagtcccactggaaaaaaagccaggcggcaaaaacggcgctcgatgccgagaaagctgaaaagtggctggacgggatttttgcttcatttgaagaaacggagtatacgaatgatcttctcggccatttgcgccgatgtttaaggcagtctctttctttcaccgattttttcgaatttcttgttgccgacatgtttgaacaagacggcttgatccttttgaattccggagacccgggcatcagaaaccttgaagcgcgctttttccggcagctgctggacaaaaacgatgagctgaccgactctgtcaaacggcagcaggaattgatgaaacaactgggttacacaccgattatcgaaggggccgcacaacatgcgaacattttttatgagcgcgacggcgagcggtttttaattgaaaaagaaaacagcgcgttttttataaaagagcttcatcttcagtggtctgaagcagagctttgcgatttgatctgccagaacccggaagcgttcagcaataatgtcgtaacccggccgctcatgcaggaatatcttcttccgacattggcgttcatcgccggtcccggagagatcaattattggggcgagctgaaaggcgcttttcaggtcatgggctataaaatgccgcctgtcgtaccgaggcttcaggttacattccttgaacggcacatcgaaaaaaagctggacgaacggggaatcgaactccgcgaatcgattgaaaagggagcgcgggccaaaaaagagcagtattttcaagataaggttccgagcggatttaccgattcggtcaaacaggcgaaagaaaaaatcgaaaacattcattccgcagtgcgcgccgaagccctcgaaatcgacggcagcctcggcccccttttagaaaaaaacgcgggcttcattcaagatcagctccaatttttggagaaaacagtcatcagaaggattgaagaaaaagaaaactatattttgcgtgattttgacaaaattcaaacaagcatcaaacctttagacgctccccaggagagaatttggaacatcgtgtattatttgaacaaatacggtccggatttcttggaaaaatacaaggatttgccatattcatttcaaaacatgcatcaagttgtcaaactttgaaataattttttaaaaaaccctgagtagttcagggtttttttttgttctaaaacagtgtaaaataaatttgtggagagaagtggtggatagtggtgagttgaggaacgaaagtgggggccgagatcatgtttatgggtgaataccagcatacgattgattcaaaaggccgcatgatcgttccggcgaaattcagagaaggcctcggcgagcagttcgttctgacgcgcgggcttgatcagtgcctgtttggctacccgatgtccgaatggaaactcatcgaagaaaaactgaaggcccttcctcttacgaagaaagatgcacgcgcttttacccgcttttttttctccggagccaccgaatgcgaattggacaagcagggccggatcaacattgcatcgccgctgttaaattatgcaaagcttgagaaggaatgcgtggtcatcggagtttcaaatcgaattgaattgtggagcaaagagatttgggaacaatacgtagaagagcaggaagattcatttgccgaaatagctgaaaacatgatcggatttgatatataatgaatctttgcgcatgcggcgcttctgcaatcagttcatttgaaaaaggtgggactagtaaagaaatgtttgagcatacaacagtattattaaaagaaacagttgatggtttaaatgtaaaagaagacggtacatatgtagactgcacattaggcggtgccggtcacagcgagtatttgctttcacagctgtctgaaaaaggcaaattggtcgcttttgaccaggatgaaaccgcactccgccatgcgaaggaaaaactggcggattatgaaggacaagtcgttttcataaaaagcaattttcggtatttaaaagaccgtctaaacgaaatcggcatcacgaaagtggacggtgttttatttgatttaggcgtctcatctcctcagctggatacacccgaaaggggcttcagctatcatcatgatgcacctcttgatatgcgaatggaccagtcggcgggcctttcggcaaaggaagtcgtcaatgaatggccttatgaggatctcgtgaaaatcttctttaaatacggagaagagaagttcagcaagcaaattgccaggaaaatcgaaaaagcaagagaacaatcgcctattgaaacaacaggccagcttgtcgatatcatcaaagaggcgattcccgcaccggcaagaagaagcggcgggcatccggctaaacggatcttccaggcgattcgaattgcggtaaacgatgagttgagggtatttgaagaagcgcttttgcaggcgattgaggtgctgaagccgggcggaagagtatcggtcatcacattccactcgctggaagaccggatctgcaaatcgacatttaaagacatgtcgtcgcctcctgaactgcctcacggactgcccgtgatccccaaggagtttgaaccgaaattaaaattagtcaacagaaagccgatcacagcttccgaagaggagcttgaacacaattaccgtgcgcgctcagcgaagctgcgcatcgcggaaaaagcacgagagtgagctgtacgaattaaaaggaggtcatcagtctatgagcaatttggcttataaagtagaaaaacagcaaagacagacagacagtgcagaacaatccgttatcatccggagaagagcatcgattacgctgggggaaaaggtattgattgtgcttttcgccctggctgtgctcagcgcttcactttttatgatttcaaaggcttttgccgcgtatcagaccaatattgaaattcaaaagctcgaaaagaaggttgaaacggaaagcagcagagttgatgacctcgaaaaagaagccgatatgctgaaagagccggaccgtatcatggacatcgcccggaaaaaaggccttaaattgggtgataaaaaagtgaaagacatacaggaatgatgcaaaatgccgaaaaaaaataaattcatgaacagaggagcggcaatactcagcatttgttttgccctctttttctttgtcatcgtaggacggtttgcgtttattcaagcgacgggaaaagtgaacggcgaagtgcttgcgcagaaggcgaacgaacagtatgagaaaaagcggacgatcgaagcccaccggggatcgatccttgaccggaacggaaaagtgcttgccgaagatgctacgacatataagcttgtcgcgattatgagcgaaaagatgaagcctcaatacgttaaggacaagcagctgacagctgagaagctcgcgccgatcctcggcatggatgaggggaaagtgctcgatattctaaataaaaaaggagcgtttcaggtcgaattcggatcggcgggacgggatttgacatacgcccaaaaagagaaaatcgaaaagctgaagctgccgggcatcgtgttcacccgcgatacgaagcgctactatccaaacggaatcttcgcctccaacctcatcggctattcgcagatcaacgaaaaaacgggtgaaatgcaaggcatgatgggccttgaaaaaacgctgaacgattatttgaaagaaacggacggatacatgacgtacgataccgacagaacgggctggcgcctgccgaacagcaatgaaaagattaaagcgccaaacaacggagacaacgtgtatttgacgatcgatcaaaaaatccaggcgtttttggaagacagcatgacgaccgttcaaaaagagtacaagccgaaaaagattatggcggcggttgttgatccgaaaacgggcaaagtgcttgcgatggggcaaaggccgagcttcaacccgaacgtgcgcgatgtcacgaactattacaacgaccttgtctcctacagctttgagccgggctcgacgatgaagattttcacattggcggcggccatccaagaaggcgtatataatggaggagaacaatacaagtctggatcatattcggtttctaaaaaagataagccgatcaaagaccataacggtggaaacggctggggcccgatcacttttaatgaaggtgttgaacgctcctcaaacgtcgcgtttgcgatccttgccaacgataaactcggcacggaccggttcaatcaatatttgcggaaattccatttttacgacaaaacggggattgacctgcctggggaagcgaacagcaaaatcaactttgaatatttgcgggataaagtgtcgacggcttttggacagagctctgctgtcacgccgatccagcagcttcaggccgcgacggcgatcgccaataacggaaaaatgatgaagccttatgtgatcgatcatgtcgttgattctgacaaaaacaaaacgatttatcaaaataaaccggaacaagtcggccagccgatctctgccaaaacggcaaaagaagtgcgcgagctgttgggaaaagtcgtcacatctgaaaaaggaacggggcagccgtacaagatcgaaggatttgatgtcgccggaaaaaccggtacggcgcaaattgccggagaagacggcagatatttgaccggccgcgaaaactacgtgttctccttcatgggcatggccccgaaggacgatccgcagcttctcgtttatgtggccgtgcagcagccgcaattaaaagctacggaaacaggctctgctccggtgtcaaaaattttcaatccggtgatgaaaaacagtcttcactacttaaatatcacaccgaaagagactgaaaaagaagaaaagcaggaagaaaaacagctgaaaatgcctgatttctccggcaaacgagccgaatccgccgcaaaagaggcgcaaggcagcagccttgttcccgttacgatcggcgatggcttggctgtgaaagaacagtacccgaaagcgggcgaagccgtcctgccgaaccaacgggtcttcctgaaaaccgacgggaaaatcacactcccagatatgacaggctggtcaaaacgggacgccctccgcttcggcgccatggcaggcattcatatcgaaacgagcggccagggctatgtgaagagtcaaaatgtaaaagcaggcaaagaattaaaagcaaattcagtcgtgaaagtcagattgaaaaacgaatagatcccgtcaaaggctatcggctcaaagtcgatagccttccgtttggacgcggccgccttgaatagatgaaaaatcgggccgttctatcaaaacgctccgaggcataaaatgaaacaagcctaaataaggagtgaacggtctcttgcgcgtttccaatgtaacggtcagaaaacgtttaatattcgttctgctttttggtgtgatcatctttttgattattgatacaaggctcggatacgttcagttcgttctcggggataaactgacgactttagcaaaagattcttggagccggaaccttccttttgagccggaaaggggcgaaatattggacaggaacggcgtcaagctggcaacaaaccaaagcgcgccatcggttttggttgttccgaagcaagttgaaaatccgatcaaaacgagcagactgctggccagcgttttgaatatgtcggaagaaaaagcgtataaacatgtcacgaaaaaaacgtcgattgaaaggatcaatcccgagggccggaagatttcccacgagaaagcaaaagaagtcagagatctcaatttgaaaggcgtatacatcgcagaagactcgatccgccattatccgttcggcagctatctgtcccatgtgctcggatttgcgggcattgacaaccagggtctgctcggccttgaagccttttatgacaaagagctgaagggcgaaaagggctatgtgaaattttattccgatgcaaaaggcaagagaatgcctggggaggcggatgactataccccgccgaaagacgggcttgatatgaagctgacgatcgattcaaaggtgcagacgatcatggagcgggaatttgatatcgcagaagcgaagtataatccggacggtatggtcggtgttgcgatgaatccgaaaaacggggagatattggcgatggtcagccggccggactttgatcccgcaaactaccaatcaatcgatcccaaagtctataaccggaacctgcctgtatggagcacatatgagccgggttctacttttaaaatcatcacgcttgccgcagctttggaggaaaacaaagtcaacctccaaaaagatcaattctatgataaaggttccgttgaagtggacggcgcgaggctgaagtgctggaagcgcggcggacacggcgcacaatcgtttcttgaagtcgtccaaaattcgtgcaacccgggatttgttgagcttggtcagcggctcggcaaagaaaaactgttcagctacattaaaaatttcggcttcggacaaaaaaccgggatcgatctgcaaggcgaaggaacaggcatcctattccctcttgaccgcgtcggccccgtagagcaggcgacaacagctttcgggcagggggtatcggtgacgccgatccagcaggtcgcggccgtttctgcggctgttaacggcggaacgctgtatacgccgtatattgccaaagagtggattgatcccgtgacaaaacaaacagtgaaaaaacagacgccgatcgccaaaagaaaagtgatatctgaagagacatccaaacagatccgctacgccctggagagcgttgtcgcccaggggacggggcggaacgcttttgtcgacggctaccgggtcggcggcaaaaccggtacggcgcaaaaagtaaaagacgggaaatatttgaaaaacaaccacatcgtctcatttatcggaacggctccttcagatgatccgagcattgtcgtctacgtcgccgtcgacaacccgaaaggaacgattcaattcgggggtacggttgcagcgccgatcgtcggaaacatcatgagagacagtcttccgcagctcggcgttaagaagcggaaagatcagatcgaacgcgaatatcaatggctggacaaaaagctgatcgaggtcccgaaccttatagggctttccgtgacagagcttgaaccattgctgatcaacctcaggctgaaggcttccggagaaggcgatgtcgtcgttcagcagtcccctaagccgggcgaaaaagtaaaagaaggatcgacgattcgcatttatcttgacagcgatgacggagcctctgattaattcgtttcaatataggagcggctgcctgctgatgtccggggccgttcctcctaaaaaatatatcgattttaaaggattagctggatgtatcctcttttttacgctaaaatatgaactgtatgtctgcacgaagctcgtgcggcgaatcaatatgacaacgaatgaagaatgattagacttgagaggtttgatacgatgaaattgacaaagcttcttacatatttaaaaaatgcaccttcctatgccggccaagaagaccctgatataacttcaattgagatggactccagggaagtcaagacagggagtctttttgtttgtataaaaggctatacagtcgacgggcatgactacgcccgccaagccgctgaaaaaggggccgccgccattgtggcggaaagggaagtggacgccgatgtgccggtgattatcgtccgtcatacgaagagagcgcttgccgtgctgtcggacgctttttacggccagccgacaaagcagctgaggctgatcggaattacaggcacgaacggcaagacatcgacttctcacatggtggaggagatctttagaaaagccgggagccgtacaggactgatcggcacgatgtacacgaaaatccacgacgaaacgttcgaggcgaaaaatacgacgccggaaagcgtcacacttcaaaaaacgtttagaaaaatggttgatcagggtgtggatacagccgtcatggaagtatcttcacacgctctccacatgggccgggtgcacgggtgtgattacgatatcgccgcatttacaaacctgacccaggaccacctcgactaccacgagacaatggaagaatataaacatgcgaaaagtctgcttttctcgcagctcggcggatcctttaaccacgaaacaccgaagtgggccgtgctgaatgcggatgaccctgcttcagcctatttcgcccaagtgacgtcagcacatcttttgacatacggaattcaaaacgatgccgatgtcatggctgaaaatatcaaaatggctccgaaagggacaacctttgacctggtgacgccaaaaggttctgcacaagtgacgattccgcttgtcggcctgtttaacgtctacaatgttttaacggctgccgcgatcgcgattgcagcggatatcccgtttgccacgattacagaaggaattgaagggctgaaaggggtcagaggaagatttgagcttgtggacgcaggccaggacttcccggtgatcgtcgattatgcccatacccctgacagcctcgaaaatgtcttgaatacgtgcagaggcttaacggaaggaaagctgtttgtcgtcgtcggctgcggtggagaccgcgataagacgaagcgtccgaaaatggcgaagatcgccgttgaccttgctgatgaacccgtctttacagccgataacccgagaagcgaaaacccgctcgccattttaaacgatatggaggaaggcgtaaaaggagcttactatcacagcatcgtcaaccgcgagcaagcgatcttttttgcaattgcaaacgccaaaaaaggcgatgtcgtcctgattgcaggcaaaggccatgaaacttaccagcagatcggcggtcaaacctttgattttgatgacgctgaggtggccaaaagagccattcttgagctgaaataatcgaaaaagaactacaggaaagagttgttgaaatgatggatgaaataaatcaacatatgaaaaaaaacagtgaatatgataaatgcgtatgctgcttcttatatcatgcggaaaggagagaagaacgatgctcgaacaagtaattttatttaccattatcatgggctttttaatcagcgttcttttatctccgattttcattccgtttttaagaaggctgaaattcgggcagagcatccgtgaggaaggtccgaaatctcatcagaaaaaatcgggaacgccgacgatgggcggcgtcatgatcatattgtcgattatcgcgacgaccattgttatgacgatgaaattttccgaagtcagcatgaacatgatcctcctcttgtttgttacggttggatacggtctgctcggctttctggatgattatattaaagtcgtgatgaagcgcaaccttggactcacatccaaacaaaaactgatcggtcagatcgtgattgctctcgtattctatgccgtctaccacttccaagggctgccgactgacatccgcattccgggaacagagctgtcgtttgacttcggctggatttatccagtgctcgtcatctttatgcttgtcggcggttcaaatgccgtcaacctgactgacgggcttgacggtctgttgtcgggtacagctgccatcgcgttcggtgcgtttgcgattttggcgtggaaccagtcgcaatacgatgtcgcaattttcgcggttgccgttgtcggagcggtgttaggatttcttgtgtttaacgcgcaccccgcgaaagtctttatgggagatacagggtcgcttgccctcggcggcgcgattgtgacgatcgcgattttaacgaaactggaaatcctgcttgttatcatcggcggtgtattcgtcattgaaacgctgtccgtcattttgcaggtcatttcatttaaaacgaccggcaaacgaattttcaaaatgagccctcttcaccatcactacgagcttgtcggatggtctgagtggagagttgtcgtcactttttggacagcggggcttctgcttgccgtcttaggaatttacatcgaggtgtggttataagtggatactcaagatttattgcaaaatcaaaatgtgctcgtactggggctggcgaaaagcggatatgctgccgcttcgatccttcatgagaaaggcgtaaaggttgtcgtgaatgaccagctgccttttgaggaaaatgaacctgcgcggattctcgcggaaaaaggggtggaagtcgtctgcggctctcatccgacggaactgtttgatcttcattcgatcgacattctgattaaaaatccgggcatccgctatgaaaacgtgatggtcgaagaagcgctgaagcggggtatcccggtctggacggaggttgaactcgcctatcatctgacagatgctccgttcatcggcattaccggttcaaacggaaagacgacaacgacaacgcttgtttatgaaatgctgaaggccgattcgaaaaaagcgctcgttgctgggaatatcggtacggcggcaagcgaagtggccaatcaggccagcggagacgaatggatcgtgacagagctgtcgagttttcagctcatggggacttatcaattcagaccgaagattggattattattaaacgtatttgatgcccatctcgattatcaccattcgcgcaaaaattatgagcttgccaaacagcaggtttatcgaaatcaatcggaaacagacgttgccgttgtcaatttggacgatgagacagtcgtccggctcgcggagtgttcaaaagcggagaaggtgtatttttcggtccgccggacacttgagcgcggagcgtgcgtgaaagacggcgcaatcatgtttaacggcgaaccggtcatgccgctggaagacgtcgttttgccgggagagcacaatttggagaacattttggccgccctttgcatcgttaaaacagcaggcgtttccgacgcggccgtccgtaaggtgctgacgagctttacaggtgttaagcacaggatgcaatacgtcgcgacgatcaaaaacagactgttttacaatgacagcaaagcgacaaacattcttgcgacgaaaaaagcgctgtccgcctttcaaaagccggtcattttgctggcaggggggcttgaccgcggaaatgaatttgatgaactaaagccgcatatgtcttttgtaaaagcggtgatcactttcggcgagaccgcgccgaagtttgagaagctggccgaagaaatgggaatacaacaggttaaacgtgtcgataatgttgaacaagcagcaactgcggcgttcagcctgtcagacgaaggagatgtcattcttctgtccccggcctgcgcaagctgggatcagtacaaaacatttgaagaacgtggtgacatgtttgtaaacgccgtgcatatgcttaaataagggcttgtctcgtaaagatagccctaagaattagagcttggggtgttcggctttgcaaacaaaaaaaacgtcaccggattttttgctggttatcattacgctattgcttttaacaatcggactgattatggtatacagcgccagtgcagtatgggcgacttacaaatacgacgactcctttttctttgcgaaacggcagcttttgtttgccggcatcggggtcatcgccatgtttttcatcatgaacgtcgactactggacgtggaggacttatgcgaaaatactgatcattgtatgtttctttctgctcatcatcgtcctggttcccgggatcggcatggaacggaacgggtcgaggagctggatcggagtcggcgctttcagcattcagccgtccgagtttatgaaactcgcgatgatcgcatttttggccaagtttttatctgaaaagcaaaagaatattacgtcgtttagaaaaggctttgtgccggcgctgggcattgtcttttcagcttttctgatcatcatgatgcagcctgacctcggaacaggaaccgtgatggtcggcacatgcatcattatgatctttgtcgcgggggcgagaatttcgcacttcgtttttctcggcctgatcggactgagcggttttgtcggccttgtgctgtcggcgccgtaccggatcaaaaggatcacttcatacttgaacccttgggaggaccctttaggaagcggctttcaaatcattcagtctctttatgcggtggggcccggcgggctgttcggcctcggcctcggccagagcaggcaaaagttcttctatctgcctgagccgcagacagattttatttttgcgattttatcagaggagctcggctttatcggcggatcgctgattcttttgctcttcagcgttctattatggagaggcatcagaatcgcgctcggtgcgcccgatttatacggcagttttgtcgccgtcggcgtcatttcgatgatagcgattcaggttatgatcaatatcggagtcgtgactggcttgattcctgttacaggcattacgcttccgtttttaagctatggcggttcatcactgaccttgatgctcatggcggtcggcgtgctgctgaatgtcagcaggtattctagatactagattttggcgataaccctgttgcgagatagcagggttatcggcgtgtacataaggattaagggggagaacagatgcggattgttgttagcggaggcggaacgggcggccatatttaccccgcccttgcgtttattaaagaagtgaaacggcatcacgaagatgttgagtttttatatatcggaaccgaaaaaggcctggagaaaaatatcgtcgagcgggaagggatccctttcaaagcgattgaaattacgggttttaaaagaaaactttcatttgaaaacgtcaaaaccgtcatgcgctttttaaagggtgtaaaagaatgcaaagaagaattaaaacggttcaagccggatgccgtgatcggcacgggcggctacgtgtgcggccccgtcgtatacgccgcttcaaaactggggattccgacgattatccacgaacaaaacagccttcccggactcaccaataagtttttatccaaatatgttgataaggtagcgatttgttttgatgaagcgaaaacacattttcctgcagaaaaagttgtttttacaggaaacccgagggcgtctgaagtcgtctctataaaagggggccgttccctgaccgctttgggtcttgcagagggcaaaaaaacggtccttattttcggaggcagccgcggtgccgctccgatcaatgaagcggtcattgcgatgcaaaacgaattaaaaaagcgggattaccaggttctttatgtcacaggggaagttcactatgataaagtcacagctgcgcttgaaaaagaaggcgccgctccgaatatggtcgtccagccgtttctccatcaaatgcccgagtacttaaaagcgttcgatgtcgtcgtgggccgcgcaggggcaacgacaatagcggaaatcaccgcgctcggcattccaagcgttctgattccgagtccgtatgttacggccaaccaccaggaagtaaacgcacgctcactcggggagcagaacgccgctgtcgttttaaaagaatcagagcttaatggagaccgcttaattcaggcgatcgatcatattttacaagacgaaaagacgttggaagagatgaagatccgcgcgaaatcgcttggcgtgccggacgctgcggaacgcttgtacaatgtgctgaaagaattgaaacatcatgcaaaatgataagacagaaggattgtggaggttttcgatggataaggtgatacaagaattaaaagaacttgaagtcggcaaagttctggaaaacgagccgctcagcaaccatacaacgattaaaatcggaggaccggctgacgtgctggtgattccgaaagacattcaagctgtcaaagatacgatgaaggttgtcaagaagcacggcgtcaagtggacggccatcggtagaggctcgaatcttctcgttctcgatgaagggataagaggcgtcgtcatcaagctcggccagggactcgaccatatggaaatcgacggcgagcaagtgacggtcggcggcggctactctgtcgtaaggcttgcgacaggcatcagcaaaaaagggctttccggccttgaatttgccgcaggcattcctggttcggtcggcggagcggtttacatgaatgccggcgcccacggctcagatatcagcaaagtattggtgaaagcattgatcctttttgaagacggaacgatcgaatggctgacgaatgaagagatggcgttcagctaccgcacatccatccttcaaaacaagcggccgggcatttgtcttgaagccgttctccaattggagcaaaaagaacgcgatcagatcgtcgcgcagatgcagaaaaacaaagactaccgaaaagaaacgcagcctgtgtccaacccttgtgcaggcagcatcttcagaaacccgctgcctgaacatgcgggccggctagttgaagaggctggtttgaaaggccatcagatcggcggggcaaaggtttcggagatgcacggcaatttcattgtcaacgcaggcggcgcaacagcgaaagacgtccttgatttgattgcattcattcagaaaacgattaaggaaaaatacgatatcgacatgcacactgaggtcgaaattatcggagaaaaacggtaaacggcctctctacttcagatcgccttatgatataatgtatgaaacaaacaagcaaacggcatcctagtatgtcgtttgtttcgctaaacggaagctttttagcttgcccccgtgctttcatatgtcgaaaagcgcgtcttttttcgaacaaaaataagcaaataaaagtctttttgtctgctttattaacctgaggtgagcctacgtgaaacccggtattgataaagaaaaagtagtgaatatagaagaacgtattcccaaaattaaagaacagcgaaagcaaaaggcaaaccgccggctgatcacctttattctgctctttttcacgatgatgctgatcatcatttacctgcagacgccgatcagcaaagtctcgaaggtagagatcaaaggaaacaaaaacgtttcaaaggaacagatcatttccctttcttcaatccataaaggacagacggaattttggagtctgagcaagcaaaaagccgcagaaaagatcgagcagaataaactgatcaaaaaagccgaaatttctaaacaactgcccaacaaaatcgccatctccatcgaagagtataaaagcattgcgtttttgcaaaaacataatgtgtactactccgtgcttgaaaacggcacggtgcttcctgaagaggtgacgccgactgacatcggaccaacccttaataactgggaggaagacgaaaagctcgttcaaatggcaaaacagctgaacaagctttccgattccgtgaaaaaatcgatttccgagatcaactatacgcctcaaaaatcaaacccttggctgatcaaactgtatatgaacgacggctatatcgtgacagcttcgctgaaaacgttcggacagaaaatgaacagctatccggcgatcgtaaaagagctgccgaaaggggaaaaaggcattatccatatggaagtcgcgacttattttgaacctctgaaaaaaacggatgaaagcaaaaagggagacggaaattgaagaggcacacagtcaatctttcactcgccatgcttgtcctcggcttcctgctgtctttctcctatcaattcgccagggaaaacaaagaccatgaagaaactgctgaaaattggaaagaggaatattccctgcgcgaccggctgatttcccaagaaaagcaaaataagaagctggaacaggagctttacaaaaaacagcaggaagtacagaaaacagagacggctttgaaaaaggaaaaaaaagagtactacaatattgtggaagatgttgagaggtacagaatgttcgtcggggaaatcggcgttcagggcgaagggatcaaagtgacgctgaaagacgcttcgtacatcccagagggtgagaatgtcaacaactatatcgtccatgaaagccacattttccgcctgctcaatgagctgtggatttccggggcggccgcggtgtcgatcaacggacagcgcgtgacacatcattcctacatatcgtgcaacggccctgtcatcacggttgacggcaaccagtatccggcgccgtttgttatttcggccatcggggatgcggatgtgctgatgccggcgctgaacattgcaggagggcttgtggaccagctgagccgcgatcatatttcagtcagcatcgaaaaacaagataatatcgagatggagccccttttgaagcaaggggaatgaacgttgaaaagttggtgggcggacattgaagaaaaataatcgtttcatcagtttgagcatcttgatgctcattttcggcattatgctgtccgtgcagttcaattcgctgaaggcgccgaaggtccgcgatacgcgggacatttgggacctcagggaggacttgaaggaagaacagaaaaaacagcttgatctgatcagcgaaattgacaagtatgaaaaaatgctgaacacatacagtcatcaagaagaaacctcgcggacaaaagcgttgaatgaaacgcttcaaaacttaaaaaaacaggccggcttcacagatgtcacagggaacggaatcatcatcaccatttctcagctcttctcggaagaattgacaggggaatcgattcaaaatccccctcccgaccttctgaaaaagctgattaatgaactgaatatgtatgaagcggaagaaatatccatcaacgacagaagggttgtcaacacgacggtgatccgcgatatcaacggaacaaccaaaatagacggttatcctttggacaactatccgataacggtaaaagtcatcggcaaaaacgccgataaactatatagccgaatgaatgcttcatccctgcaggatctgttcgcgggagaaaatctggatttgcaaatcaaaaggcctgaaaaacaaatcaaaatcaaagcttacgaaggttcaatgcaagttgcgccattgaaaccgctcgaaaaatcaaaaggagagaattcctaatgtggcttccggttttagggcttttgctcggaattacaatcgggttcagcacgaatttcaccattccggatgagtactcaaattatttgtccctggcgattctggcatcgctcgatacgttgatcgggggaataagggcccatttggaaagtgtatacgatgaactagtttttgtgacaggctttttcttcaatattattcttgccataagtttggcttttctgggcgttcatcttggtgtagacttgtatttagtcggtatgtttgcatttggcgtgaggctttttcaaaacatcgcggtcatcagaagaatactgctcgccaaatggacggcatcgaggagaaaaaattaaaaaaaatcggatttaaaagaggatatacataggatatcacgaatattcacagtaatcctaaaactgaaaacgaagcgtattggtttgtattgattgttacacacttgtaaaaccagattcattgtattgttgttcggcaaataatagaatagaattgactgaaatgtgaggaggtgccatagaatgaacaacaatgaactttacgtcagtctagacatcggtacgtccaatattaaagtgatcgtcggtgaaatgtcagacgattctcttaacattatcggagtcggaaatgttccctcagaggggctgaaaaaaggatcaatcgttgatatagatgaaacggttcattctataaaaaaagcgtttgaacaagcagaaagaatgataggttttccgctgacccacgcgatcgtcggggttaatgggaactacatccatattcaagatacgaacggtgttgtggctgtctcaagcgagaataaagaaatccacgttgaagacgtgcgccgggtgatggaggccgctcaagtcgtttccatcccgcctgaacagctgatcgtcgatgtgattccgagacagtttatcgttgacggaagaggcgatattacagatccgaaaaagatgctcggcgtccgccttgaagtggaaggatcgctgatcacgggctctaaaacgattttacataacctgctccgctgtgtggaaagagcgggaattgaaataacggatatttgccttcagccgctggctgccggatctgtcgctttatcaaaggacgaaaaaaacctcggagtggctttaatcgacatcgggggaggatcaacaacggttgccgtatttgaggacggccaccttcttgcgacccgtgtcataccactgggaggagaaaacatcaccaaggatatttcaatcggattgcgcacctccacggacgaagctgagcgggtgaaaaagcagtttggacatgctttctacgaagaagcgtcggaagaggaaacatttgaagtcgccgtgatcgggacggaccaaaagcagacctttactcagcgggaagtggcagacattatagaagccaggcttgaagaaatctttttattcgtggcagaggaactgcggaacatgggaataaaagaattgccgggaggctttgtgcttacagggggacaggctggaatgccgggggtcctcagcctcgcacaggatgttcttcaaaataacgtcagagtggctagcccgaattatatcggtgtaagagaacctcaatacatgacaggagtcggcctcatccaattcgcttaccgcaacgcaaaaatccaaggcagaaaagtagggtttaagatgccggaacaagcggttcaggaagtcgcggcaactcatcaaaaagaagtgcagcagcgaccgaagccaaaatccaagcagcaggctcaagctgagaaaaagccgagcaaaatgaagaaaatatttaacttcttttgggaatagagattagtcattcgacggattaggaggatttagcatgttagagtttgaaacaaatatagacggcttagcatcgattaaagtaataggagtaggtggcggcggtaacaatgccgtcaatcggatgatcgaaaatgacgttcagggagtcgagtttatcgcagtcaacacggatgctcaggctctcaacctgtcaaaagcggaaacgaaaatgcagatcggtgcgaagctgacgcgcgggctcggcgccggagccaatccggaagtcggcaaaaaagccgcagaggaaagcaaagaacaaattgaagaagcgctgaaaggtgcagatatggtgttcgtcacagccggaatgggcggcggaacaggaacgggcgcggcacctgtcatcgcacaaatcgcaaaagatctgggcgcattgactgtcggcgttgtcacaaggccgtttacctttgaaggaagaaaaagacagcttcaggctgcaggcggtatttcagcaatgaaggaagccgtcgacaccctgatcgtcattccgaatgaccgtcttcttgaaatcgtcgataaaaacacaccgatgcttgaagcgttccgtgaagcggacaacgttctccgccaaggtgttcagggcatttcagacctgatcgcaacgcctggactgatcaaccttgactttgccgatgtcaaaacgatcatgtccaacaaaggttctgcactgatgggtatcggtgtagcgacaggcgaaaaccgcgctgcggaagccgctaaaaaagctgtttccagcccgctgcttgaaacggcgattgacggcgcccaaggcgtgctgatgaacattacaggcggcaccaacttaagcctatacgaagttcaggaagcggcggacatcgttgcagctgcatctgaccaggacgtcaacatgatctttggatctgtcatcaatgaaaacttaaaagacgagatcgtcgttacggtgatcgcgactggatttatcgaacaggatcaagattcatcaaagccgcagagacctttaaaccaaggcttaaaacagcatcatcagcctgctccgaaacgggagccgaagcgcgaggagccaagcatgccgcatcgcagcccatcacagcctgccgaggatacgcttgacatcccgactttcttaagaaaccgcaataaacgctaaacgtctacaatacattggaaagctgccgacaagaagtcggcggctttttttgcgcgctggaacagcagccgatgttccttcccctccaaaagcatcaattgtcttcttgatggaagcggctccctcaaaagccttgcatctaatctctctcttttctcccgaatgtacagattttccttttttcttgtcatcaggccgaactatgaacggtgaacaagtcatatgtaaaaagaacgaatttgcaaactgacaaaggaaaaatgacagaatacgacaatatctataaaccttttctattaccattattaatagattctgtttctagacatagaaacgcaagaaacgactatatttgctattgcttaaaggaggatgtcatgtgaagaaaaagccattattccgcacgttcatgtgcgctgcactcatcggttcacttctcgctccggttgctgtgcaggctgatacaggcacggcagcgaagacaaaggaacaaagcaaaatatctagcgctctttataaacgttttgagaaagaaggtaaagtgacctttttaattaaaatgaaaagccaggcgaaccttcagcaagcggcaaccgcggctgaaaaacgggcgaaagcaagcgttatgaccgtgaaaaaagcaaaagagatcaaacgctcggcagtgctgacttccctgcgtacaaaagctgaaagaacacaaaaagatttgaaatcgtttttggaaaaagaagagaaaaaaggaacagctaagaaagtggaatctttctatattgtaaacggcatcgccgtgacggcgacaaaagatgttatggaaaaagcggcttcatttcctgaggttgaaaaggtgctgcccaatcaaaaaatcaagctgggcaataccgaaaaacctacagtagaatcgaaaacaaccgcggatcgcacccctgcttccaacattgagcaggttcatgcgccggatgtctggaaaaagcgctataaaggcaaaggagccgtcgtcgcttcaattgacaccggcgtagagtgggatcatccggcgttgaaaacaaagtacagaggctacaacccttctaaaccgaacagtccagacaatgagttcaactggtttgatgcggtaagcaataagaaaacgccatatgatgacttgggccacggcacacatgtgacaggcacgatggtcggctcagaagccggcggcaaaaaccagatcggtgtcgcgccgacggcgaaatggatcgctgtcaaggccttttcagaggacggcggagatgaaaaatcccttttggctgcaggagaatggattttggccccgaaagatgcgaaaggaaaagcgcaccctgaaaaggctcccgatgtcgtcaacaactcttgggcaggggaacgcggactcgatgaatggtatttggatattgtcaaagcttggcgggcagctgatatcttccctgcatttgcagcgggcaatgtcagcgaattcgaaccgggcggaccgggttcagttgaaaacccgtccaactatccgcaatctttcgcgattggcgcagttgacagctcaaacgcgttagccgacttttcattgcaagggccttcgccatatgacgaaatcaagcccgatatttctgcacctggcgtcagcatccgctctgcttatccgggacataagtatgctgcaatgaacgggacatcgatggcgaccccgcatgtatccggcatcgtcgccttaatgagggaagccaatccggacctcacagtcgatgaaatcgagcgcatcctgctgaaaacggcgacgcctctgactgacaaaacgtttaaaaaatccccgaacaacggctacggatacggcttggtcaacgctttaaaagcttttgacgcagcaaaaaaaactaaatgataaaaaaggacaaaacctttaagcggttttgtcctttttttatctaattttaaacaaggccttgacaaataccgacaaaataattaaccagtttttactatatttaagttacatcaaagtcagacaaggcgtccacaaggagggggggacaggaaaattcagctaatttcataaaaaagggggatgttcatttgaaaagaaagctgagaaaaaaggcgttttccaccattttaagcggtttgttaatcggctcgctgttcatgcccgccgtttcagatgccgcagcaaagcccgcacttacttccatgaaagaacaagcagccgcagggaaggggaaaatttcaaaaactcttgtcaaacagttcaaaaaagaagatcaagtcacatttttgattaaactgaaagatcaagtcgatacaccaaaagtggccaaacaggcggaaaagaacgcgaagaaaaagtcgctgagcgctgctaaaacagaatatcaaaaacgctcggctgttgtttccgctttaagagtcaaagcggatgagtcgcaaagcgatctgaaacgttatttgaaaaagcaggaaaaacaggggaacgtaaaaaaaatcagatcctattatattgtcaacggcatggccgtccatgcgacgaaagaggtcatggaacaagtagcggcttttccggaagtagaaaaagtgcttccgaacgaaaaaaggcagctgatcaaaccgactaaacagtctgtgaaaaaatcagcagccaaggatgaaaaagaaatcgaatggaatatcaatcgagtcgacgcaccaaaagcctggaaattgggatatgacggatcgggcacggttgtcgcgtcgattgatacgggcgtgcagtgggatcatccggccttgaaagaaaaataccgcggatatgacccgaagcatcccgatcagcctaaccacgaattcagttggtatgatgcggtttcaggcgcttctgaaccatttgacgatctggagcacggcacgcatgtaaccgggacgatggtcggctcagagcctgacggccaaaaccaaatcggcgtggcgccgggtgcgaagtggattgctgtgaaagctttttcagatgacggcggaacggacgaagaccttattgcagcaggtgaatggattttggcgccaaaagataaagacggcaacccgcaccctgaaatggcgtcggatgtcgtcaataactcatggtcagggggagccgggattgatgagttttacagggatatcgtaaaagcgtggcgagctgccggcatctttcctgagttctctgcggggaacgtcgatttcgccaatccgggaggacctgcttcgattgccaatccggcaaactaccctgaagcgttcgcaaccggagcgacagacatcgataatcgcttagccgatttttcacttcaaggtccttccccgtatgatgagactaagcctgaaatatcggcgcctggtgtcaacattcgctcatctgtgcctggaagcggctatcaagacggctgggacggcacttcaatggctggcccgcatgtcgcagccgccgccgctcttatcaagcaagccgattcgtcgatcactgttgatgagaccgaaaagattttgatggaaactgcaacaccgctcacagacagcaaatttaccgaatcgccgaacaacggatacggccacggactcgtgaacgtgtttgacgcagtgtccgctgtgacaggcgggttgggcagagcggaaggacaagtcggaaaagaaggcgaagacaaaagtccgccggccttaaaccatcaagagatcaccgaaatttactcaggctcggaaacgcctcttaaagctgatgtagaagacgatgtcagcatcatatcggtcaaattgagctataaaacagatgacgccgattgggagacgatcgctgccaaacaaacttccggcgactataaaaaaggaacgtacgaggcggctgtaactgtttctgaagggaaaaccctttcctacaagtggattgtcaccgatttcggaggcaacaaaacggaatccaaagtgtacgaagtcccgatttccccggctgtgacaacagggtataaacaagatttcgagaattccgccagcggctggctcacatcaggcgtgaagaattcatgggagcgcggaattcctcagtcaggcccgaacgccgcagcatcgggaaaaaacgtattcgcaacaaatctgacagggccgtatgaaagttcggctaatatgaatcttctcatgcctcctgtcagcgttccaaaaaatcaaaagctttatctcacatacaaatattggcacgatattgaagaggactttgattacggcttcgtttacgtacagcctgaaggaaaaggtgaatggatcccggctgccgagtacagcggcaagacatcagaatggaaagacggacagatcgatttgtcggaatacgggggacagacgattaaggtcatgttcaaccttcaatctgacgacagcattgaaggtgacgggctgtacatcgatgatgtagcgcttgtcaaggaagtgaagagcgccggtacgaaaaaacgattgggcgttgaaaaacagccggccaaaatgaaggataagaaaacaaagaaacgaatgattgatccgaaaaaagcaaaaccggcagaagcccttcaggaaaaaaccgaaacgaaaaaagcagctcctgcggttcttccggtgcgcgctcaggtcagcgtgctggaaacgggcaaatcgacatattccaaccaggcaacaggcgcatacagcttggctcatgcacctggaacctatacgctgaaagcggaagcgtacggatatgaatcaaacgcccaaaccgtaaaaatcgagtccgacaagacaacaacggcagactttgttttaaaagaactaaaaaaagggacgctcaccggaacgataaaaaataaaaaaacgggcgaacccgtccggcatgcaaagttgtatatcgttgaagatgcagctgtaaaaccagtccagacggatgatgacggaagctattcattaacggcctatgaaggctcgtatacggtaaaggtctctgcaaacggatattacagcagcgagttttccgttgatttaaaaggcgatgtctcgaaagatatcgatctcgatcctttcatcggctatccgggggaaataggctatgatgacggaaccggggaaaacgcctgggctttctatgaatccggcaacgggctggccgttaaaatgacgcttgaaaacgggcaggaaaaagccatgctgaaaggcggtttgtttaaattctgggatacagaattccctgatccgggcggcactgattttgcagtagaggtctatgatgcttcgggtgaaaaaggctctccgggcaaaaaaatcgccggcccgttcaagactgaagcgctccgcacaggcgaatggacgaccgttgatttaggtgacgaaggcatcatcgtcggaaaagacttttacctcgtatacgtccagaaagaggatctggccaactcacctggacttgctacagacgaagacggagaatattccggccgcaactggcagtatacggacggctcatggtcaaaagcgccatcagaccaaggcaactttatgatccgcgctttggtcgactatgaattgtcggtgcctgtgattacgtctcctaaagacggattcatcaccaaccaaaagaacgctgtcattgaagggacatcctcgccgaatacgaccgttcatctctttaacggggatgaagaagccggaacagcggaaacggcggcagacggcactttctcaaaagaaataccgttgaataaaggggaaaatgtcatcaccgcgaaatcgtcatcggcttccggaacgactgatgcttcagaaccggtccggatcgtccttgaccagaaaaagccgaagcttacaatcgacacgccggaaagcggctcaaaactcaataaagagaccgtcaccgtgaaaggaacagtatcagacgatcacttagaatctgttcatgtaaacggcaaaaaagcagctgttgacaatggcgaatattctgcaaggattatgcttgacaacggcaaaaatgaaatcaaagtaacggcatcggatgcggcaggcaacaaaacgaccaaaaaggtcacggtagatgtcaactttgaagcgccgcaaatcaccggcttgaaaccggccgaagatctcgagctcaaaacgggagaaaccgtgaaaatcgagtttgaaagcgccgctgatttggatgctgtctttgtgatcagaatgccgctgaccaatttcaaaaccgctgcccaaaacgtaacggagctgccgatcagagaagtctcaaaaggaaaatatgaaggatattggaccgctacttcaactgcaaaagcaaaaggagcggaaatcgaggtcatcgtcagagatgattacggcaatgaaacgagacaaacggcaaaaggcaagctgtatatcaatgaaaagctgaaataaaggtgaaaagacgctgtctttaatggcagcgtttttttcgttttacgatcgacaaattcagtacgaaaacttcaaaaaatgtacgatttacgcaacattaattgacagactttacctttgggcttgatttatacttaggaaaacaaacactaaggtcaccgagccgcagaaaggggaaggatgtggaaatctatttagatgcgatatggctgttaaacttttgttttgacttgctgcttttaatgatgaccgcatttattttaaagcgaagggttaaaaagcggaggctgatcctaggggcatttgtcgcgtcaagcatcgttctgtttatgtttacacctttttcaccgtacgtccttcatcctgccggcaaactgtcgttttcggttgtgatcgttcttgtggcatttggttttaagcggttccggttttttttgcagaatttgttttctttttattttgccacttttttaatgggaggagggattatcggagcgcattctttgcttgaaacggattcgatcatggaaaacggcgtctttatgacgaattggtccggttttggagaccccgtcagctggctgtttgtctgtgtgggttttgcggctgtatggctgttttcaaaaaagcgttttgaagatgctgaagcgaagaaaattcaatacgaagaacgcgtccgcctagaggcctgcattggtgaacatacgcttcatttcaccggattgattgactccggaaaccagctctacgatccaatcacaaaaacgcccgtcatgatcgtcaatattgaaaaattgaaagttgtattgggagaagaggcaagtgtgaccatcaaggaaatgagcccgcttgatgccgtcgggaaactggatgaagcactgccgtatatcgggcggatccgcctgattccgtaccgcggggtcggccatcagcatcagtttctgctctgcttaaagccggatcatgtgctcgtttgtacggaaagagaagtgattgaagcgccgaaatgcctgattggcatcagcacatcaccgctttccgctgacggcgaatttgacgccatcgtccatccgaaaatgctggccggaaacccggtcaaacacgtttcttaaacttgaagtctgttacattatcatactcctgaagacgtttatttagaagggggaggaagatgaaaaaactaaaattaaggttaacctatctatggtacaaacttttaatgaaactggggctgaaaagcgacgaaatttattatatcggcggaagcgaggcgcttcccccgccattgtcaaaagatgaagagcaggtgcttctccataagctgcctgacggtgatcaggcggcacgagcgattttgattgaacgaaatctcagactggtcgtgtacatcgcgagaaaatttgaaaatacaggaatcaatatcgaggatttaatctccatcggcacgatcgggctcatcaaagcggtgaatacgtttaatcccgagaaaaaaatcaaactggctacatatgcttccagatgcattgaaaatgaaattttgatgtatttaagaagaaacaataaaatccgttcagaggtatcattcgacgaaccgctgaacatcgattgggacggaaatgagctgcttctctcagatgtgctcggaacagaaaacgacattattacaaaagacatcgaagcaaacgttgacaagaagctgctgaaaaaagcgcttgaacagctcaatgacagagaaaaacagatcatggagctccgtttcgggcttgtcggaggggaagaaaaaacacaaaaagacgttgccgatatgctcgggatctcccagtcatatatttcccgacttgaaaaaagaattattaaaaggctccgaaaagaattcaacaagatggtttaatttttttatgaaatttgaagcattgacagtcaagggttttcggctcgatcttcttatttttggaaattaacgatgcatatttttcccacccgaggagatactgaactttgtacagcagctcctgtagggagggaaaaaagtgtcgaggaataaagttgaaatctgcggggttgatacatcaaaactgcccgtactgaagaacgaagagatgagaaagttattcaagcaaatgcaggatgaaggagacacaacagcgagagaaaagcttgttaacggcaatttgcgccttgtcttaagcgtcattcaaaggtttaacaacagaggagaatatgttgatgacttattccaagtcggctgcatcggactaatgaaatcaattgataattttgacctgagccacaatgttaagttttcaacatatgctgtaccaatgatcatcggagaaatccgcagatatttgcgcgataacaacccgatccgcgtctcacggtcactcagggatatcgcgtacaaggcgctgcaagtgagagaacggctgatcagtgagacaagcagggagccgactgctcaggagatcgctaaagagcttgaagtgtcccatgaagaaatcgtttttgcgcttgacgccattcaagatcctgtatctttgtttgagccgatttacaatgacggaggagatccgatttatgtcatggatcaaatcagcgatgagcgcaacaaggattcgcaatggatcgaagagctcgccttaaaagaaggcatgagacggctgaatgaacgggaaaaaatgatcctcagaaaacgcttcttccaaggcaagacgcaaatggaagtcgctgatgagatcggaatctcccaagcccaggtctcaaggctggaaaaagccgccattaaacaaatgaataagaacattcactaagccgcagtcaatctgcggcttttcacatgctaaaaatggaaaatctctcattcactttattaaatatataagctataataaaagaattatattttaatttatcagaatatttacataaaaaaagggggattttaagtggttctgcagcttgagcatgcttcactaaaacgaaacggagagtggatattaaaggatattgattggacggtggaaaagggggagcactgggcgttatacggattgaacggagccggcaaaaccgcactgctcaatatgctgtgcgcttattattttccgacaacaggaaaagtcaccgtgttagggcgcgaattcggaaaaacggagcttggcgagaagcttcggcgaaaaatcggccttgtttcagccgccctgcagcagaagctttatcctgaagacagtgcatttgaaattgttttaagcggcgccttcgcttcgatcggcctttatgaatcgccttcacagtctgtcagagagaaagcggtcgccctcttggaggaattcggctccatccgctatgcggacaggagatatgaaacgctctcccagggagaaaagcaaaaggtgctgatcgcaagggccttgatggccgatcctgagctgctgattctcgacgaacctgtcaccggtctagattttatcgcgagggagcaggtgctggagacggttgaacaaattgccaagaaagacagtgcgccgtccatgctttacgttactcaccatgcagaagaaattctccccgctttcagccaaaccctgctgttaaaaaaaggggaagtgtttgcgttgggaaagacaagagagatgatgtccggcgaggttctgtccgaatttttcgatatgcccgtccaggcggtatggacggaagatcggccgtacttgtccaagaaaaaaactgcaaacctcaatgtttaaagcttcggatgtgtttgggagcctccttctattatggaggctctatttcagctttcatcatcttaaagaagctggtaagataataaagaacgtcatgttttaggggagttcatcattatgatcattcaattcattcgctacagataatgaaaggtatagacaaacgcttagcccatccacacctatggctttaaaaatgccgaaggagcgggtttatttgtctatgcctttttcattgatctaaatacgaatgaatgaggtgtaacaatgatgaataaaaaattaaaaagagcagcgcttatgaaggagcatgaaacgatgtttcagtgcccgctatgcgccgcgaacatggcgatcagcgagttaaaaagccttatatgttcaaacagacatacgtttgatatcgcaaaaggagggtatgtcaatgtcgcgacgcattctccttctgttaaatatgatatagatttatttgaagccagaagaatgttagcagccgccggcttttttgaaccgatgagaggcgcgttgacagaccgtcttaaacaagccggcctgccgttttgcaattttgtcaggatcctcgatgccggctgcggggaaggttcgcatttgacgcgaatcgctgaaacgctagaagcgcgtttcggaacgcctgtccttggagtcgggctggatttggcgaaagccgggattgtatcggcggctaagcaagaaagagaggcgatctggtgtgtcgccgatctggctgccgcaccgtttcggaatcgttcattcgacgcgatcctcaatatattgtcgccttctaattacgcggaattcgagcggctgttatcggatgacggcatcgttttgaaagtgattccgagaagcggccatctgaaagaactgaggagatttttgtacgacggctcggacaaacaagcctatacgagcgaggatacggctgagcgcttcgcgtctcattttgatctgatcgacagaacggagatcgcctacagcaaacgtttagaccgaatccagctcccgccgctcatcaagatgacgcctttatcatggcgcgcgcaaaaggagcggatcaatgcctttctaaagaaggaatccgctgttatgaccgtccatctcgatattttagccggcaggaaaaaaacgaaataaaccactgaaaaggcagtctaaataaaggactgcctttcatataatcttaaaaggacatttgatcagaggaggcgtgcggtggacatgatgaatatttctgatttccagataaaagatgtcgttaacgtatcaaacggaaaaaagctcggcagcatcggcgatatcgatataaatgtaacgacaggcaaaatacaggcgatcgtcatcggaggaacggggaaagttttcggatttttcggaaaagaagaggaaatcgtcattccgtggcgaaatattgttaaaattggagaagatgtgattcttgtgcgtttaagctgatctagcacaatcagatgctgcctgatcaatcggcggacctttatccgcctgcttttttcaaaatgttgtgaacgatgagaacgtctgcaaaagcagggataaatgttgcaaacaatacatttcgtttagttttttgaaacgaaactaaacgaatgcatcaagatgtgttaaaataggagcgatatgatgaaagactacgatgtttgtcgaaaggctgatcaccatgaatacatataacccctttcgtcttgatgctccgtcaatgcttttgattgaggaatggaatcagacggcggaaaccggcggagccgtcacagccggatttacgacaaaaaacggcggagaaagcgaaccgccttttcactcattgaatacagggctgcacgttcaggatcatgaacagcatgtcatcaataacagaaaaaaggttgccgacatcctaaaaacagatctgcacgactgggtatttgctgatcagacgcatgaagaccggattcataaagtgacggatggcgatcgcgccagcggcgctttccgatacgatacggcgctgaaggctacggacggactttatacagacaggccaaacctgtttttggcgctttgctttgccgactgcgttcccgtttatttttacgatccggtccgctcgctggtcggcatcgctcacgcgggctggaaaggcaccgcacttgggatcgccgccagcatggttgacacgtggatcaggcgggaagggtcgaatcccgcagacatccgtgccgtgatcgggcctgcgatcggttcgtgctgctacactgtcgacgatcatgtaatagacaaaatcagaaatcttcctcttcagcaagaagacaaagcctttttgacgataaaagaaggggagtaccgtctcgaattaaaagaagtgaacaggcagctgcttgtacacgccggaattccaaacggccagatcgaagtgagttccctttgtacgagctgcgagcgttcactgtttttctcccatcggagagaccggggaaaaaccggacggatgatgtccttcatcggattaaaggaggtatagcttacaggtggatgtaaaaagcaatttacgacatataaatgacaggatcaacgaagcgtgtatcaaagcgggcagaacgcccgacgaaatatccgtcatcgctgtcacgaaatatgtttccccggaacgggcgcaggcagcgctggatgcaggaatcaggcatttgggtgaaaaccgtgataccgggctgcttcacaagctcgacgttctgaaagacagcgaaccggtatggcattttatcggaaccctgcagacgagaaaggtaaaagcaatcatcgatcatgtctcatatatccattctttagacaggctttcactggccgatgaaattcaaaagagggcaaaaaaaccgattgactgttttgtccaggtcaacacatcccttgaaccttcaaaacacggcatggcaaaagaagaagttcttccttttgtaaaaaaactgtctggatacgaaaacattcggatcgcgggattaatgacgatggctccttttacggatgatgagaaggcaatcagaagctgttttcgcttgctgagagagctgcgcgacgaggtgcggggccttgatcaatggaacgctccgtgcagcgagctttcgatgggtatgtctaacgactatgcgatcgcagtcgaggaaggcgcgacattcgtcagaatcggatcttccttagtcggaaatgaaactggaggtggacaatcatgagtttgaaaaacaaatttaaaaactttttttccttggatgatgaggaatacgaatacgagtatattgaaacagacagggaggaaatccctgaagagcatgaatcaaaagacagaaccgcctaccagtctaaagcggctgggaagcagaatgtcgtaagtttgcaaagcgttcagaaatcttctaaagtagtgttaagtgagcctcgggtgtacgcggaagcccaggaaatcgcagaccatatcaaaaaccgacgcgccgtcgtcgtgaacctgcagcgcatccagcacgatcaggcgaaaagaatcgttgatttcttgagcggaactgtatatgctctcggcggcgatattcagcggatcggagcggacatctttttatgcacgcctgagaacgtcgatgtttccggcacgatttccgagctcatagaagaagaacatcagaggtggtaaatcgcagatgatcctactttatcaaattttaagcacgcttttaaccgtctattcttttgcgctcattatttacatttttatgtcttgggtgcctaatgcaagggaatcttcattcggccgggtgcttgcttcactttgcgagccttatctcgaaccgttcagaaggatcattcctccgctcgggatgattgatatttctccgattgtggcgattttcgtcctgaaattcgcagatgcagggcttcttgcggttttcagaatgctcggcgctttttaattgagatcatgccgatttcccgtaaggacttgccggcggcagcggcgccgcttttcatgagtgtgccttcaatctttgcgggccgagtatcgggcttggctgtagccaggcctctttacatagaaaggaaagacaatgagcgatatttaccagcatttcagaaaagacgaagagccgtttatcgaccaggctcttgagtggaaaagaatcgtagcggaacagtaccggatgaagctgaccgattttttggatccgcgggaacaggtgatcctgcagtctgtcatcggtcagtcggacgaagtgaggcttgaatttttcggggggttccctgaggctgaacgaaagcgggctgtgctgttccccgaatatgccgagccgtctgccgaagattttcagcttcaagcctgggaagtcatctacccgcaaaaatttgcctccatcgagcatcgcgagcttctcggctcattgatgggcatcggattgaagcgccaaaagttcggcgatctgatcttttcggacggaacatggcagtttatctgttcggaagaagtcgctgattttgttttcacccagctgacacaaatcggcaaggtgaaagtttcccttgaaaaaattccgctttcaaagcttaaagtaccggagcaggatgtcgaaataagggatgatacggtttcatctttgaggcttgatgcgatttgctcggcaatgagcaggcaatcccggcagaaagcacaggttcttgtgaaaaacggcctcgtgaaagtgaactggaaagtcatcgaagacccttcatatgcactggctgaaggggatatggtttcgatccggggatttggccgcttcagaatgaaaaacattgacggcaaaacgaagaagggcaaatggagattgacgtttgaaaaacaaaaatgacgcgttttaacagttttttctccgcccggtcgaattttgctttataatgttgactaggacaagtgtacataaagaaaaaaatggaggtgggcagcatgcctttgacgccaaatgacattcataataaaacatttacgaaagcgttccgcggctatgatgaagatgaagtgaacgaattcctggcccaggtgaggaaggattatgagatcattctgcgcaaaaaaaatgagcttgaaacaaaggtgaacgagcttgacgagcgtctcggccatttttcgaccatcgaagagacgttgaataaatcgatccttgtcgcacaggaagcggcagaagacgtaaagcgcaattccgagaaagaagcgaagctcatcatccgtgaagctgagaaaaacgctgatcggatcattaatgagtctctttcaaaatcgagaaagatcgcgatggaaatcgaagagctgaaaaagcagtcaaaagtgttcagaacccgtttccaaatgctgatcgaagcgcagcttgacctgttgaaaaacgatgactgggatcatttgcttgaatacgaagtagacgcagtaatggatgaaaaggaatagattttcgtttgcaatcttgacataccgtcatctgttcgcatataatacgttcataaattgagtgaaaaacgtttgagagggacagacattgattcctgaaaacaatgaaagcgacccgggggcggtgtaagcccgggattgttggaatcgttgtgtatcagccctcaagtttcctttctgaaccgtccagtaggaaaggacgtcccatcacgttacgatgtttgagcggataagccgaatcggcttgtctaaaagggtggtaccgcgagatcaaagccttctcgtcccttatgggatgaaaaggctttttttgttttagaaaagatgttttggaggaatggtaatggattataaagacacgctcttaatgccgaaaacagattttccgatgagaggaaacctgccgaaccgcgaacctgaaatccaggggaaatgggaggatatggacatttacagcctcgttcagaaacgtaccgaaggccggccgatgttcgtgcttcatgacggaccgccgtatgcgaacggcgatattcatatggggcatgcacttaacaaagtactgaaggatttcatcgtccgttcgagatcgatgagcggctatcatgcgccgtacgttccgggctgggacacacacggcctgccgattgaaacagcgctcacgaagaacaaaaaagtgaagcgcaaagaaatgacagttgccgaattccgcaaactttgcgaagaatatgcatggcagcaaatcgaaggccaaaaagcgcaatttaagcggctcggtgtcagaggagattgggaaaatccatacgtgacgcttaagcctgagtttgaagcgcagcaaattaaagtattcggcgaaatggcgaaaaaaggctatatttacaaagggaagaagccggtttactggtctccttcaagtgagtctgctctggctgaagcggaaatcgagtaccatgataaacgctctccgtctatctatgttgcatttgatgtaaaggatggaaaaggcgtattaacaaacggcgaaaagattgtcatctggacgacaacgccgtggacaatcccggccaacctcggcatcgccgtacatcctgaactggagtacagcgtcgttgctgccggcggcgcgcgctacgtgatggcaagcgcattgattgaaagcgtggcaaaagcgatcggctttgaagatcatgaagtcgttcagactgttaaaggtaaagatttggaacatatcgtcgcagttcatcctctatacggcagagattcgcttgtgatgctcggcgaacacgtaacaacagatgccggtacaggctgcgttcataccgctcctggacacggggaagacgactttatcatcggtcaaaaatacgggcttgacgtgctttgtccggttgatgaaaaaggacatatgacgagcgaagcccctggttttgaaggactgttttacgatcaggccaacaagccgattacagaacagctcgaagaaaaaggcgctttgctgaagcttgatttcatcactcactcctatccgcacgactggagaacgaaaaaaccgactattttccgtgcaaccgcccaatggttcgcttccatcaaagactttagaggcgagcttcttgaagcggttaaagaaactaaatgggtgcctgaatggggcgagacacgcctctacaatatgatccgcgaccgcggcgactggtgtatttcaagacagcgcgcatggggcgtgccgattccggtattttatgcggaaaacggggagccgatcatcacggacaaaacgatcaaccacgtttctgaactattcagggagcacggttcgaacatttggtttgaaaaagaagcgaatgaactgcttccggaaggctttactcaccctggaagcccgaacggcaagtttacaaaagagcaggacatcatggacgtctggtttgattcaggttcgtctcatcaggccgtactggaagagcgcgaagatcttgtaagacctgccgacttgtatctggaaggatctgaccaataccgcggctggtttaactcatcgatttcgacagcggttgccgtaacaggcaaagcaccttataaaggcgtgctttcgcacggttttgctcttgacggagaaggccgcaaaatgagtaaatcactcggcaatgtcgttgttcctgcaaaaatcatgaaccagttcggggcagatattttaaggctgtgggttgcgtctgtcgactatcaggcagatgtccgcgtgtctgacgcgatcttaaagcaagtcgcagaagtgtaccggaagatccgcaacacgttccgcttccttcacggaaacattactgattttgacccggcgaaagatgcaatcgctgtggaagatctgagagaagtcgatcagtacattttgatcaagctgaacagcctcattgaaaaagtcaaaaaagcgtatgaagaatacgattttgcggtcatttaccatgctgtccacaacttctgtgcgatcgagctcagctcattctatatggactttgctaaagacgtcgtttatattgaacacgccgatcataaagaccgccgcagcatgcagaccgttttttacgaaacgctgcttgcgcttgtcaagctgatcgcgccgattctgccgcatactgcggacgaaatgtggagccacttcacattcgtatcggaaaaaagcgtgcagcttacagatatgccggaaacaagagacattccgaatgcaaaagagacggaagagaagttcgacagcttcatgaagctgcgcgacgatgttcttaaagcgcttgaaacagcacggaatgaaaagatcatcggaaaatcttcggttgccagcttgacgctgtatccgaatgaagaagctaaagcgctgctttcttcaatcaaggaagacgtcaaacagctgttcatcgtgtcggagcttgccatcggcggaacggaagccgatgcgcctgaggatgcgcagtcgtttgaaacaggaaaaatcgtcgttgctcaggcagaaggcgagacttgcgagcggtgccgcatggtttccaaagaaatcggcgaggatcccgatcatccggaactctgccctcgctgtgctggaattgtgaagacgtattatcaaaattaaccatgaagcggttcggagtttttccgaaccgcttttagcatgccgccaaaccttatcatttgctgtcatgcctgctaagtaaataaaaaggatcggcagctaacctgcttgaacgccgccgccacatcctgtgaaagtccgcagtaaggatgccattgctgacatcgttttgtacgtcaggaaaaatcttttgggcttggataccggcattgtcggtaacactaaggtcacaaacgataagagcaggagttgatgtaggcgtgaacgagcagctggcggcaattcataccgaacttcttcaaatgaaggaagagttggaagcaaggctttttgaatactccttttttcagcaggattctcagggcatcagttcgtatcagcaggcaacacttatgtatcatgtaaaagaagagcttcaggacgtgcttttggccctttcaaaaatcgaaaacggaacatacggcatttgcgaagaaacaaatcaggctattccgctggcaaagatggctattctgccgacggcgcgcactgcgaacgattttttatatcatgcccaatttgaaaaaaagacgcttcctatttgggctgagacggatgaaacgttcaaccgggcgctctactcataacattctgcaagaggggagggcatttgccctcttgcaggatgtcaatgaatattcctttactccttttctttttcttgttaaaatgcttaaatgaagagaaacagaaactggaggaacggtttgtgccttattacataattgcgctgctcattatcggtatcgatcaatttacaaaatggctggtcgtcagcaaaatggagtacggtgaaagcatccccgtcatcgatggcttctttcagattacgtcgcacaggaatacaggtgcggcatggggcattttggccgggcagatgtggtttttttacatcattacgacggtggtgatcatcggcattgtatactacattcaaaaacatgcaaaaggacaaatcctgctcggaatcgctctcggtttgatgcttggcggtgctgtcggcaatttcatcgaccgcgtgttcagacaagaagttgtcgattttatccacgtgacgatcgtcaattatcactatccgattttcaacattgccgattcatctttatgcatcggagtcctgctcttatttatacaaatgctgttagacggaaagaagaagaaggagctgtaacatggagcattatgatatgaccgttcatgaagaacataaaggtgaacggattgacaagtacttgaccgcagttgaagcggattggtcgcggactcaagtacagcagtggattaaagaagaccgtgtgctggttaacggaaatgcggtgaaagccaattataaagttcaggaaggggatgcggtgtcagtccaggttcccgaaccggaaccgctggatgtcacggctgaaccgatggatcttgatatttattatgaggaccaggacgtactggtcgtcaacaagccgcggggaatggtcgttcatccggctcccggccatttgacagggacgctagtcaatggtttgatggcgcattgtgacgacctgtcaggcatcaacggcgtgatgagaccggggatcgtccaccggattgataaggacacttcaggcctgttgatggttgccaaaaacgacatggcgcatgagtcgctcgtgaaccagcttgtcaacaaaacagtaacgagaaaatacaccgcgctcgtccacggcgtcatcccgcatgaccacgggacgatcgacgcgccgatcggcagggataaaaaagacaggcagagtatgacggttacaagggaaaacggaaagcatgccgtcactcattttgaagtaatcgaacggttcgacgattttactgtcgttgaatgccagcttgaaacggggagaacccatcaaattcgcgtgcatatgaaatatatcggctttcctctcgcgggagatccgaaatacggaccgaaaaagacggtcgatttcaacggccaggtgctgcatgcgggcgtattggggtttgaccatccgcgtacgggagaatatgttgaatttgaggcgcctctgcctgacgacatgaaaaacctcctcgacaaaattcgaaataaacgttgacagacgttttcttttttgaaataataaatgcagttaaatcagattctttaacacagtccagagaggctgagaaggataccggacaagcgaatcaatgaattcgtttaaagacccctctctgcctttatgcagaaggggtttttgttttatcctttaaaagatgcgaggtgtttggccatgcaagagcaggaaaaggctgttgtgcttgacgaacaggcgatcagaagggcgctgacaagaatcgcccacgaaatgattgaacgaaacaaaggaatgaacaactgtatccttgtcggaatcaaaacgagaggcatctatctggccaaacggcttgccgaacggattgagcaaatcgaaggaaacaaagtcaccgtaggagagctggacatcaccctttaccgggatgatctctccaaaaaaacgtccaataaagagccgcttgtcaaaggagcggacattccggcggacatcaccgatcaaaaggtgatcctcgtcgatgacgtgctttacacgggacggacggtcagagcggccatggatgcgctcgtcgatgtcgggcggccttcatccatccagcttgcggtgcttgtcgaccgcggccacagagagctgccgatcagagccgactttatcgggaaaaacatcccgacgtcgaaaaccgaaaaggtcatggttcaattggaggaagttgacggacgcgaccttgcggcgatttataaaaagtgaatgataatcctataatccttttttaaatgcattccagtgagtttgcaaagagggatggaacgaaagaaagccgccttaccgtgcggcggtctttgtctgcctctttgcgcaatttaagcaaagaggcttttttaatgggcataaatcatttcaggatatgaagacatcatagacagtgagtcgatcatcaggaggaaaaaatatgagtcagaaaaaagtgaaccttggtgtcagagaagtaccaaaacctttgaattggatatctttcagcctgcagcatctgtttgccatgttcggagcgacgatccttgtgccgaagcttgtaggcttaagcccgggcgtggccctcattacaagcgggcttggaacgcttgcgtatctcttgattacaaaaggacagatcccggcttacttaggttcatcctttgcatttattgccccgattatcgcggcaaaagccgccggaggccctggcgcggccatgatcggcgcatttatggcaggcatcgcctacgggctgatcgcccttctcatccagcagcttggaacggactggctgatgaggcttctgccgcctgttgtcgtcggtccggtcattatcgtcatcggactcgggctggcaagcacggctgtcaatatggccatgtatgaagattcgggagcaaaagtgctcgtctacagcgccaagcattttggcgtcgcaggattcacactcgcgctcaccataatctgcgcgattttcttgagaggatttttcagcctgattcctgtcttgatcggaattatcggcggatacttgttcgccctgacccagggaatcgtcgacttccagatggttcttgacgccaaatggtttgctgttccggacttcgtgcttccgtttgtcgactatacgccgagcgcggcggctgtcggaatcggaatcgccatggtgcccgtcgctttcgtgacaatgtcagaacatatcggacaccaaatggtattaagcaaggtcgtcggccaggattttattaagaagcccgggcttcaccgctcgattttcggcgacagcgtcgcaacgatgcttgcatcatgcatcggcggacccccgacaacgacttacggagaaaacatcggcgtactcgccatcacaagagtattcagcgtatttgtcatcggcggagcggctgtcattgcactgtgcttcggatttatcggcaaaatttcggccctgatcagctctgttccttccgcagtcatgggaggcgtttccttcctgctgttcggtatcatcgcatccagcggactgcgcatgctgatcgataataaaattgacttggaaaacaagcgaaacctgatcatctcatccgtcattctcgtcatcggagtgggcggcgcatttatcaagatctcagggtttgagctgtcaagcatggcgcttgcggcgatcgtcggagtggttttaaaccttgtcctgcctgaatcaaagggagatcaggacggaattgaaatagaagagcatatttaaaaaccttttaaatgaagtccagagaggcttgaaagggttgcggagagagaagtgcaaaaaagcgcattctctgattcactgtaccccaagccgttatggcctggggtttttttacgggaaattaagcctgagggggagaaaaaatgaaacacttgaccgcaatgaatgagcttagtcttgaggatattcacgagctgattgaagaggcgagagagctgaaaaaaggcaagtccgattccgttctctccggaaagttcgctgccaacctgttttttgaaccgagcacaagaacgcgcttcagcttcgaagtggctgaaaagaaactcggcatgaatgtgttgaacctggacggtgtttcaacgagcgtacaaaaaggagaatcgttgtacgataccgtcaagaccctcgaatccatcggcgctgatgtatgtgtgatcagacactctcatgatcattattacgatgaactcatcggacatgtcggcattccggtgatcaatgccggagacggctgcggtcagcatcccactcagtctttgctcgatttgatgacgattcacgaggaatggggcagatttgccggactgacggtatccatacacggagatatcaagcacagcagagtggcaaggtccaatgccgaagtgctgacaagactcggagcaaaggttcttttctcaggtccagacgaatggcgggatgaagacaatccatacgggacatatgtgtcgcctgacgaagcggttgcacattcggatgtcgtgatgcttctccggattcagcacgaacggcatgagaaaaaggcggcagaacgcgattatctcgaaacattcggattgtcgctcaagcgggcggagctcttgaaaaaagacgcggtcatcatgcaccccgcacctgtcaaccgaggcgtcgagattgacagtgcactggtcgaatccggccggtcgaggattttcaaacaaatggaaaacggagtatatatcagaatggcggttttaaaaagagcgcttctaaacggcgaaaacaaaaaaaggggagatcaggcttatgtcttatttaattaaaaacggtttcatgctcgacgaaaaaggcgaaaaagtacagcgcgatatcagggttgaaggcgatgcaatcagcgagatcggaagccttgaggccgcttcgggggaaacggtcatcgatgcggatggacttttcgtctcgccagggcttgttgaccttcacgttcacttcagagagccgggcggcgagaagaaagaaacgatcgaaacaggtgcaaaagccgcagcgagaggcgggtttacaactgtcgccgcaatgccgaatacccggcctgtccccgatacgaaagagcagatggagtggcttgtcaaccgcattgacgaaacggcatcagtgagagtgctgccgtatgcttcaatcaccatcaggcaaacaggtcgggaaatgaccgatttcgaagggctgaaagacgccggcgcgttcgcgtttaccgatgacggcgtcggcgttcaaacggcggggatgatgtatgaagcgatgaaaaaagcggcttcgattaataaagcgatcgtcgctcactgtgaagacaattcactgatctacggcggcagtgtacacgatggggaatttgccaaagccaacggtttaaacgggattccttcggtgtgcgaagcggttcacatcgcaagggatgtgcttcttgccgaagcggcaggctgccattaccacgtctgtcatatcagcacgaaggaatcggtcagggtcgtccgcgacgccaaaaaagcgggaatccgcgtgacggcggaagtgacgccgcaccatctgctcctttcagacagcgacattcccggccttgatacgaattataaaatgaatccgccgcttagaagtccggaagacagggaagcgctccttgaggggcttagagacggaacaattgattttatcgcaacggatcatgccccgcatacagaagaagaaaaacaacagacaatgagccttgcgccttttggaattgtcggcttggagacggcttttccgctcctttacacgcactttgtcaaaacaggcaaatggacgctgaaacagctgcacgattatatgacggtcaaaccttgcgaggcgttcgggctgccgtacgggaagcttgaagccggacggtccgcggatattacgctcattgatcttgaacgcgaagaaaaaattgataaaagcacctttctttctaaagggaaaaacacgccgtttgacggcatcagctgcttcggctggccggctatgacaatggcaaagggaaaactcgtttaccaagaggggagacttgtaaaatgaaaagacgtcttatattagaaaacggaacgatttttgaaggggaagcattcggcagcctggaaaacaccatgggagaagtcgtcttcaacacggggatgacaggctatcaggaaatcctctcagacccgtcatactgcggacaaattgtcaccctgacctaccctttgatcgggaactacgggatcaacagagacgactttgaatccatcaccccttatgtaaaagggtttatcgtaaaggaattatgtcaacttccatcaaactggcgctctgcttatacacttgatgaatatttaaaaatgaaaaacatcccgggactctcagggatagacacgagaaagctgacaagaatgatcagaacggcaggtacgctgaaaggggtatttgccggccctgaagaagatgctggggctttggttcaaaagctgaaagaaacgaaccttccgaccgatcaggtcagccaagtatcaacaaaaacggcatatccgagccctgggagagggaagcgaatcgtgctcgtcgatttcggaatgaaacacggcatcttaagggagctgaacaagcgcaaatgcgatgtgatcgtcgttccccacaatataacggcagaagaagtgatgcagctgaagcctgacggcgtaatgctgtcaaacggacccggagatccaacggacgtaccggaagcgattgcgatgatccaaaacattctcggcaaggttccgctgttcggcatctgtctcggccatcagctgtttgccctcgcctgtggagcaaagacggagaaaatgaagttcggacaccgcggttccaaccatccggttaaagagcttgaaaccggcagagtatcaattacggctcaaaaccacggctataccgtatcgtctgttgaaaacacgccgcttgaagtgacccatgtggcgataaacgacgacacaatcgaagggcttaaacataaacacgaaccggcttttacggttcaataccatccggaagcttcaccggggccggaagacgcaaaccatttatttgatcaatttttagacatgattgaaaccacagagaaagaaggggaagcggtatgcctaaacgcgtagatatcaaaaagattttggtgatcggatcggggccgattattatcgggcaggcggcggaatttgattatgcaggcacacaggcctgcctcgctttaaaagaagaaggctatgaagttattctcgtcaactcgaatccggcgacgatcatgacggatacggaaatggccgaccgcgtgtatatcgaaccgctgacgcttgaattcttaacacggatcatccgcaaagagcggccggacgccatattgccgacattgggcgggcagacgggcctcaacttggcggtcgaactgtcagagcacggcatcttggctgagtgcggcgtcgaagtgctcggcacgaaattgtcggcgatccaaaaagcggaggaccgcgatttgttcagaagcttgatgaatgagttgaatgagcctgttccggaaagcgagatcatccactcgctcggcgaagcgcgcgagtttgtcgagcgcatcggtttccccgtcatcgtcaggccggcatacacgcttggcggaacaggcggaggcatctgctcaaacgaagacgagctgaaggaaatcgttgaaaacggcttaaaaatgagcccggttcatcaatgcctgcttgaaaagagcatcgccggctacaaagaaatcgagtatgaagtcatgagagactcgagcgaccatgcgatcgtcgtctgcaatatggaaaacatcgatccggtcgggattcataccggggacagcatcgttgtagcaccgagccaaacgctgagcgaccgcgaataccaaatgcttcgcaatgtctcgctgaaaatcatccgcgcgcttgaaatcgaaggcggctgtaatgttcagctggcgcttgacccggacagctttcagtactacatcatcgaggttaacccgcgggtcagccgttcttctgcgcttgcctcaaaagcgacgggctatccaatcgcaaagcttgccgcaaaaatcgctgtcggtttgtctcttgacgaaatgatgaatcctgttacaggaaaaacgtacgcgtctttcgaacctgcactcgactatgttgtgtcaaaaataccgcgctggccgtttgacaaatttgaatcagcaaaccgcaggctcggcacgcagatgaaagcgacaggcgaagtgatggcgatcggaagaacgtgggaggaatctctcctgaaagcggtccgttctcttgaagcggatgtctaccatctggaactgaaagatgccggtgagatctcgaatgaagtgcttgaaaaacggattaaaaaagcgggagacgaacggctcttttacctggccgaagcgttcagaagaggatacacagtcagcgacctccacgaattttcggcaattgacctgttcttcctccacaagcttgagggaatcatccgctttgaagagaagctgaaagccggacgcggcgacctcggccttttaaaagaagcgaaagagctcggcttttcagaccgctttatcagccttctctgggagatgcctgaacgaaagctttatgatcttagaaaagaagcaggcatcacgcctgtttataaaatggttgatacatgcgcggccgaatttgaatcggagacgccgtatttctacagcacgtatgaagaagaaaacgaatcggtcagaacggacaaaaacagcgtcatcgttcttggctccggtccgatccggatcggccagggggtcgaattcgactatgcgaccgtgcattcggtctgggcgattaaagaagccggctatgaagccattattatcaacaacaatcctgagacggtttcaacagacttcagcatatccgacaagctctactttgagccgcttactgttgaagatgtcatgcatatcatcgatttggagcagccgaaaggcgtcgtcgttcagtttggcggacagactgcgatcaaccttgccgacgagctcgcagaaaggggcgtcgccattctcggaacatcccttgaagatttggaccgcgccgaggaccgcgacaagttcgaacagacgcttgaaatgctgcaggtaccccagccgcttggaaaaacggcgacatctgtggaaggcgccgttgaaatcgcagccaatatcggctatccagtgcttgtccgcccatcgtatgtactcggcggacgtgcgatggagatcgtctaccatgaagcagagcttctccattatatggaaaatgcagtaaaaatcaatccgcagcaccctgtcctgatcgataaatatttgaccggaaaagaaatagaagtggatgccatttctgacggtgaaacggtcgtcattccggggattatggagcacatcgaacgggcgggcgtccactcgggggattcgattgccgtttacccgccgcaatccctttcagaggacatcaagaaaaagcttgaagcatacacgattaagctagcaaagggcttaaacatcgtcggcctgctcaacattcagtttgtcctttcaaaagatgaggtttacgtccttgaagtcaacccgagatcgagccgaacggtgccgtttctcagcaaaatcaccggcattccgatggccaatctcgcaacaaaggtgattctcggagggaagcttgccgatatgggctatacagaaggcctccaaaaagagcaggaaggcgtatatgtgaaagtgccggtcttctcgtttgcgaagcttagaagagtggatatcacgctcggaccggaaatgaaatcgaccggggaagtcatgggcaaagacagcacattggaaaaagcgctatataaaggactgatcgcttcaggcattcaaattccgaactacggctctgttctcctgacagttgctgataaagataaagaggaagggctgttgatcgccaagcggttccatgcgatcggctataaaatcttggctacggaaggaacggcaggctatttaagagatgcatccgtacctgttaaaaccgtcgggaaaatcggcgaagaaggtacaaatctccttgatgtcattcgaaacggggaggcgcagttcgtcgtcaatacgctgacaaaagggaagcagccggcaagggacggcttcagaatcagacgcgaatccgttgaaaacggcgttgcctgcctgacatcccttgatacggcggaagcgattttgcgggtgcttgaaagcatgagcttccgcgccgatcatatgccggcgattaaaatcgcccaaaaggcggccgtcagatgagaaaagggtatatgacagtccgttcaaacaagtgcatcgcggatcatatttatcaaatggtgcttgaaggggagattgccgaagtttgcggcgctcccggccagttccttcacatcaaggtctcagacaccctcacgccgcttttgaggcggccgatcagcatcgctgatatcaacaaagccgcccggcaggtgaccatcatctttcgcaaagatggggaaggaacgagactcctttctttaaaacaggaaggagatcagctcgatgttctcggtccgctcggcaacggttttccggctgaatcgcttgaacaggggaaaacggctcttctcgtcggaggagggatcggtgttccgccgctttacgagctgagcaaacagctgacaaacagaggggtgcacgcgatccatgtgttaggatttgcttctgcaaaagatgtcttttacgaacaggaattcagccgtttcggccgggtgtatgtggcaaccgcagacggcacccgcggttcaaagggatttgttacagatgtcattgaaaacgaggggcttcagtttgactgcataatggcctgcggaccgacgccgatgctgaaagctttaaaacagcgctatccggataaagaggtatatctgtcaatggaggagcgcatgggatgcgggatcggcgcttgctttgcctgtgtctgccatacggaagaaagcgaaacgtcttatgtgaaggtatgccttgacggtcctgttttcaaagcccaggaggtgctgttatgatgcttgaaatcaatttgccgggccttcaattgaaaaatccgatcatgccggcctcaggctgcttcggattcgggagagaatttgcgaacttttacgatctttcgcgtctcggtgcgatcatgattaaagcgacgacgagcgagccgcgcttcgggaatccgacgccgcgcgtcgccgagacgcaagccggcatgcttaatgccatcggcctgcaaaatccgggtttaaaggctgtcatggaacgcgaattgccgtggctcgaacagttcgatacaccgattatcgccaatgtcgccggctcgcagatcgaggattatgttgaggtggctgaagaaatcagcaaagcgccaaacgttcatgcgctcgagctgaatatttcctgtcccaatgtgaaaaccggaggcatcgccttcggcacgcagccggaaatggccggcgagctgacgaaagcggtgaaagaggttgcgagcgtccccgtctatgtgaagctgtcgccgaacgtcgcgaacattaccgacatcgctcttgccatagaagaagcgggagcggacggtttgacgatgatcaacacgctgatcgggatgcggctcgacttaaaaacgggaaagccgattttggcgaacaaaaccggcggattatcaggacctgccgttaaaccggtggccatcagaatggtgcatgaagtcagccaaaaggtcagcattccgatcatcggcatgggcggcgtccagtcagccgaagatgtgcttgagtttttgctggcgggtgcgagcgcagtcgccgtcggcacggcaaacttcgttaatccgtttgcttgtcccgacatcatcgacgatttgccgcgcgttttagaaaaatacggataccgttcgttgaacgagtgtatcggaaggagctggaaggatgaacaatacgccgcccatcatcgcgcttgattttgcatcagcacaggaaacatatgcgtttttggaccggtttcaaggagaagagctgttcgttaaggtgggcatggagcttttttatcaggaaggacctgccatccttgaaaatctgcaggagcgcggctgccgcattttcctcgatctaaagtgccacgacattccaacgaccgtatacaaggcgatgaaaaggctggcgggatttggcgtcagtcttgtcaatgtgcacgcagcaggcggaaagcaaatgatggagtcggcgcttgaaggccttgaagcggggactccggcaggccaaaaacgcccttcattaattgccgtgactcagctgacaagcacgtcctcagaaatgcttcagcgtgagctcctgattgaaacgccgcttctcgatacagttgtccactacagccggctggctgaagaaagcggtcttgacggcgtcgtctgctccgttcatgaagccgaacacatttaccgggctgtgtctgtagattttctgaccgtgacacccggaattcgcatggcagatgacaaaaacaacgaccaggtccgggtggcgacgcctggctacgcaagggaaaaaggcgtgtcggcgatcgttgtcggccgttcgattacccaggcggaagatcctgtgtcagcctacagaagaataggacatgagtgggagggaaccaaggcatgaaaacagacattgcaaaccatttattaaaaatcaaagcggttttcctgcgcccgaacgaaccgtttacatgggcgagcggcattctgtcgcccatctactgcgacaaccgtttgacgctttcatatccggaagtaagagatgatatcgcttcagggcttgccggactgattcaagacaaatttcccggagccgagatgatcgccggtacagcgaccgcgggaatccctcatgccgcgcttgccgctgacaggctgagcctgccgatgtgctacgtcagaagcaaaccgaaggcgcacggcaaaggaaaccaaattgaaggggccgttgtaaaaggacagaaagtcgttgtgatcgaagatttaatttcaacgggaggaagcgttcttgaagccgccgccgccctcacagaggcgggatgtgaagtgctcggcgtcgccgccattttcacttacgggcttccaaaagccgccgccgccttcagcgaagcaggcgttgaataccacacgctgactgattacgatacgctgaccgaggctgcgcttgccggtggatatattactgaacaggatgccgccaaactgaaagaatggaaagcggatcctgaaagcaagtcttggatgaactgatgatcaaagccgtattctccaaatgggagaacggcttttttgcgcctttttgccgtttttaaaatagtaaaatcggattatttttattttttattaatcctataaaaaaagtcgggttgacttttattcgaattgtgctaaaattttaaaataacaaaagcaaacttatcaagagcggtggagggactggtccgatgaaacccggcaacctgcgtgtgaagcgtaaggtgctacttccagcaaaatgccctcattttgagagataaggaatagcggagttcctcgtctttctttcaaaattggaagaaagattttaattttttaggggcagaggaggagctagaagtgaagacagatgaacagcttgaaaaggtgatcatcaaaatgaaagacatgctgaaagacatgaattacggatcgatcacattcgttgttcaggacggcaaagtcattcaaatcgaaaaaaatgaaaaaataagattgaaatagctgactagacaaactagaggcggttttcacagttttttttctgctggaagccgtttttttgttggcgaaaaaagggggaaccgaaaatttttacttacagcacatgggaggaaccaaacatctcttttcaggaagatgactcttataaaggagcgctgtccgtcctgaaatgggcgtacggacattacggggatcagctcgtatacgcgtgcagcttcggaattgaggggatcgtcctgatcgatttgatttataaggtgaaaaaagatgcagttatcgtttttcttgatacagggcttcattttaaagaaacgtatgaaacgatcgacgccgtcaaagaacgatatccaggccttcagattatcatgaaaaaaccggagcttaccgtcgaagagcaggcgaaagaatatggggacgaactatggaagaccgctccgaattcctgctgcgaaatgaggaaggtcatccctctccgcgagacgctttcaggctacccggcgtggctgtctggtctgcgccgcgagcaatcgcccggacggagcaaaacgaattttttgaacaaagatgaaaaattcaagtctatcaaagtttgtccgctcattcattggacgtggaaggatatttggagatatgtgacaaagcacgatctcccatacaatccgcttcatgatcaaggctatccgagcatcggctgcgctccgtgcacctctccggcctttacaatggatgatcttcgatccggccgctggaacggatcggctaaaacagaatgcggattacacgagtaaggagatgagtcatggaacttgccgccattttatttagcatgttttttgcgatgaatatcggagcgagcggtgcagctgcttcaatggggatcgcctatggatctgaagctgtcaaaaagaagtttcacgccctcctgatctgtgcagcgggcgttctctcgggcgctgtcatcggcggaggaaacgtcgtgaaaacgatcagttcaggcatcattcccgaacgggtgatttcgcttgaaatcgtctgcattattatcggatcagcggcgctgtcgctctttatcgcaaatgtactcggcattccgctttcgacaagtgaagtgacagtcggatctgttgtcggagtaggtgtcgcataccaggttttgtatgtcaaatctttgcttgtcatcgtctcattttgggtcattgtaccaatcgtcgcttttgcatttacatttgcgatggcaaaaatcatgaaaaaaacgatcaaacgtccagcctcgggaaaaaaagcaaaggttttggcggtcattctattgatcacagggttttttgaagccttctcagcgggcatgaacaatgtcgcaaacgctgtcggacctctggtggcggcgcatgttttgacagtcggggaaggaacgctctacggcgggctgtttgtcgcgctgggcgcccttttactgggcaggcgcgttcttgaaacaaacggcaaaaagattacgaggttttcaaaaggagagggaatcatcctttccggaacgggggccgggcttgtcattaccagttcaattttcggtttaccggttccgcttgcgcaagtcacatcatcttctattatagggatgggaatggcaaaaaacggcggcaacgtctttcataaacaagtggtcaaaacgatgctgaaagtatgggtcgtctcgccgttcctttcattaagcctatcttatatgctggtcagccttttattaaaaggagactactacgctcttattgttgtcacaagcgttctgctggcatctgtcggaacgatcagcctgatgagagcggtcaaaaaagagcacagctccgtccatgaacaaggcggaggaatttaaacacaaagtagggggaaacaagtttatgagtttagcaccacacggcggtgtattggttaaccgcgtcaatgaagcatacgattttcaacatatcgcacatgaaattgagcttgatgtaatggctttttcagatttggagctgatcggaatcggtgcgtacagcccgctccaaggctttatgacagagaaagactatctgtccgttgtcgaaaatatgagactatcaagcggcgaagtatggacgcttccgatcactctgcctgttgacgagcaaaaagctttaagcttaaaagcgggtgacaccgtccgccttacctataatggggaaacctacggcgtcattgagatcgaagatatctatacgccggacaagaaaacggaagccgtcaatatctataaaaccgacgaactcgaacatccgggcgtcaaaaaattgtttgaccgcggcagcgtttatgtgggcgggccgatcacgctcattaagcggagtgtaaaacaattcccggcgcacacattcgaacctcttgaaacaagaaaaaaattcgcggaactcggctggaaaacgatcgtcggattccagacgagaaatccggttcacagagcgcacgaatacattcaaaaaacggcgctcgagacggtagacggccttttcctcaatccgctcgtcggggaaacaaaatcagacgatattccggctgatgtccgcatggaaagctatcaggtgctgcttgacggctactatccgaaagaccgcgtcttcctcggcgtttttccggcggcgatgcgctatgcggggccgaaggaagcgatcttccatgcccttgtgagaaagaactacggatgcacgcactttatcgtcggaagagaccatgccggagtcggcgattactacggcacatatgaagcgcaggagctgttcgatcagttcgcgccggaagaaatcggcattacgccgctgaaattcgaacacagcttctactgcaatgtctgcggttcaatggctacggcgaaaacgtgccctcacggcaaagaacatcatgtcattttatccggcacaaaggtgagggcgatgctgagaagcggcgagttcccgccgagcacattcagccgtcccgaagttattcaaacattaatcaaaggcttagcggccggggtttcttaagggggagcatctcttggtaaataaagatattgtctggcatgaagcgtccattacaaaacgggaatatcatgagaaaaatcaacataaaagctcaatcatttggctgacgggcttaagcggttcaggaaaatcaacgattgccaacgccgctgcgcgtgagttgtttgcacaaggctaccaggtcacggtgcttgacggcgacaacgtcaggcacgggctgaacaaggacctcgggttttccgatgaagaccggaaggaaaacatccgccggatcggcgaggttgcgaagctctttgtcgaacaggggacgatcgtcattacggcgttcatttctccttttaaagaagatcgcgggcttgtcagacagcttgtcgaggaagatgagtttcacgaagtctatgtgaaatgcgatttggcgacgtgtgaagagcgcgacccgaaaggcttgtacaaaaaagcgagaaacggagaaattccatttttcacagggatcgattcgccttatgaagagcctgaaacgcctgagcttgttcttgatacaggcgcacataaccgggaagagtgcaaaaaccagctcgtccaatacgtgaaagatcaaacgaaataaaatgcgggtgaataggaaagtgcggcgcatgcactttcctatttcataaagaaaacgtttggtttttgtgatattttcaggcaccaaacgctttctttatgatttataatgaattgaagaagacgttgatcagatcggggggagatctaagatggggaaagtatatatcgttggggcaggtcctggagaccccgatttactgacgatcaaagctttaaaagccatccagacagccgatgtcattttgtatgacaggcttgtgaataaacagattttacagcacgccaaggagggagcggatctcatctactgcggaaagcttccggactaccacatgatgaagcaggaaacgatcaatcattttctcgtcaagtatgcgaaaaaagggaaaaccgttgtcagactgaaaggcggcgatcctttcgtattcggcagaggcggcgaggaagcgcaaaccctcgctgagcacggggttgcttttgaaatcgtgccgggaatcacctcgggaatagctgccgctgcttatgcgggcattccggtgacacaccgggaagcgagttcaaacgttgctttcgtgacaggccattatcaaaaagaagaaaactttgaagagaagtggaaagcgttagccacagggatcgatacgcttgtcatttatatggggattaaaaacgtgaagcaaattgaaaggcttctgatcgaaaacggcagagacccgtcaacgccagccgctttcatccattggggaacgacagacaaacaaaaaacggtgctttgcacggttgaaacgcttgccggtacagtcgaaagcgaaaagattgaaaacccgagcctgattgtcatcggggatgtcgttcaattcagctcgcagttaagctggtttgaacctgagctgaaagatccggcattaagcgaggcgctttaatatgaaacaagcgattttatatatcggccatggaagccgtctgaaaagagcccaaacagaagcagccgcttttttggagagctgcaaagaaaacatgtccgcccccattcaggaaatatcttttttggaattggcggcaccggatatcgaaaccggctttaaagcgtgtgtggaaaagggggcgacgcatatcgcggccgtgccgcttctcctcttgacagccgcacatgccaaaagggacatccctgaagagcttgcccgtgcttcctcacagtacccttccgtcagcgtcgcttacggaaagccgatcggcgtcgatcaggaagtcgtcaaagcggtttttacaaggatcgaagaaacggggacgccatatgaacatgcaagagtcgtgttgatcggaaggggaagctctgatccggatgtcaaacgggatgtttatgatatttgcgaacggctgagagacctcacaccagtggatgaggtcattccctgctttatgacagcctgtgagccgcactacctggatgtgtttaaacagcttaaagaacgggacggaaaaacgacattcatcgttccgtatctgctgttcaccggtatgctgatgaacgagattgaaagggaaaccgcaaagctgaaagaaacgaatccgaatgtcgtgctgacggattacctcggcttccacccccatgtaaaaaacgcctttttgcaccgcgtagaggaagcggttatcaacaaagccggccgctttgattttacaggagcatcagatgctgccgctgcacattaacatgaaaggcaaagccgcagtcattgcgggcggggggaagattgcggcgcggcggctgaaaacggtgctggcagaaggtgcatccgcgaccgtcatcagccctgaagcatcagaagagatgctcggattgattaacgaacacggcatcgaatggaagaagaaaaaggcggaacccggtgatttcaagaatgcatttctgatcattcttgcgaccgatgaccatgaggcaaacaagcgtctcgccgcatcggcagctcctgagcagctcgtcaatgttgcgagtgaagcggagctgggaaatgtatatgttccaaaaataatcaacagaggaaacataaccatatccgtctcaacaaacggagccagcccgcgccacacgatcaggctggccggacagatcgatgatttgatcgatgatgagctcgtccaagagatcgacgagcttttccgaaaaagaagaggcctgaacccttgaggttcaggcttttggcattattattttttcagcttgatgatcaagtcttcatcaggtgttacaaaaacggtttgctggctgtcgtaggtgacaaaccccggttttgcgccattcggttttttgacgtggcgtatttttgtatagtcgacgggaaccgaagcggagtttttcgctttgctgtaatatgcagcgatctgcgccgcttccagaatggtttgctcgtccggatcggtcgattgaatgacgacgtgcgaccccggaatatcttttgtgtgaagccagatgtggtcgcgggcggcaagcttcatcgttaaatattcgttctgcttgttgtttttgccgacgagaatcgtttctcctgagctggactcatatgcttcgagcgtcggcgcctgttttttctgtttcttctggcccccttgctgcttggcccgcaagtattttccttcggcgagctcttcgcgaatttcggttatatctttcggtgaggcagatgaaagctgctgaatcagctggtcgaaataagcgatttcctcttctgccaatttgatctgctccttcacgacttctaccgaatttttcgctttttgatattttgtaaaatagctttgtgcattttcagaaggcgttttattaggattgagcggaatcgtgatttctccgccgttttcatcatagtagttgatgaccttcgcctctttgtccccttttttcagctggtacaggttcgctgtcaacagctctccgtacagctgatagtcttgcgcgtgttcggactgctcaagcgtttttttcagctttttgattttattttcgttctttttcttttcgtttgccgcgaaacgctctaaatcgtgagcctgctgtttgacgcggtcacgctccgcttttccgaaatagtagcggtcaagaagttcgctcagcgtatgaaagggcctgttgtctccttttatatgggtcagctcaagaaggtaaaaatattcttttccgtcttctgtggtgacaagctggggctgaaaacgccggcttttgatttcgctgaacatctccgtcaagacgtttggcagtgtcgccctgttggctagacccgcgcgaaagacggcttccttcgcaaacagaggcgagacgccggagaaggtatcgacgatctgcctgtcaagtttgccttcctggaaattcagatggcggagaatatcttcagtctccgcttcaagcggagacaatttgttctgcgcgggagggagaatgtaatcgtatcccgggagcacggtgcggtagctgttcatcgcaggtgacagatgcttcaaactgtcgatgatgacgtctttttctccgtctgttaacacgatgttgctgtgcctgcccatgatttcgaccatcagctttcttgtcagcgtgtcgccgatttcgttccggctcctgatatgaaagaccatcattctgtccatgccgatttgctcgacttggtcgataaagccgccttccagatgtttgcggaggagcatgcagaacatcggaggggtgctcgggttgtcgtaggtttcgtttgtcaggtgtacccgcgcataactcggatgggcggagagcagcaatttgcggttcttcccgtttgccctgatatgaaacactagctcgtgcttaaacggctggtggatttttgcgatccgtccgcctcgaatcgcctcatttaattcctcgatcattccgtatgtaaaaatgccgtcaaaagacatatgaaaaactcccttttctcgttaatcctcttcgtaaaacgtccattcaataattatagcatgatttgggacgagtctgaataaattgacttatagagatggatacaccaaaagcaacctttagggcaggaggagtggacgattcaatgaaatggcacgagatgggacaaaccgaattgttaaatataacaaaaacgtccatcgacaaaggtctaacagaaaaagaggccggaaagcggctggaaagacacggaacaaacgaacttcaggaaggggaaaaaacatcggcggtcgcattgtttttttctcaattcaaagatttcatggttcttgttttgcttgcggccacgttgatttcgggtttcctcggcgaatacattgacgccatcgcgatcatcgcgatcatctttgttaacggcattctcggattctttcaggagaggcgggcggaaaggtcgctcgaggctttgaaagaactgtcagctcctcaagtggctgtgctccgggaggggaattgggtgaaaattccttccaaagagcttgtcccgggagatgttgtccgttttgcaagcggagacagaatcggcgccgatctcagacttgtcgagacaaagagccttgaaatagaagaatcggcccttacaggtgaatcgctccccgtgtccaaacaggcagatgcttttcaggcgtcagatgtatcgctgggcgatctgaagaatatggctttcatgggaacgcttgtcacaagggggagcggaatcggcgtcgtcatcggtacgggtatgaactctgcgatggggaaaatcgccgatatgcttgaatctgccgggaatacggcgaccccgctgcaaagaaggcttgaagagctcggcaaaattttgattgtcgccgctttgttcctgacactgcttgtcgttgctgccggcgtcattcaggggcatgatttatacagcatgtttttagcgggagtttcccttgccgtcgctgccatacctgaagggctgcctgccattgtcacggtcgctctgtctctcggcgtgcagcggatgatcaggcaaaagtcgatcgtcaggaagctgcccgcggttgagacgctcggctgcgcgtccattatttgctccgataaaaccgggacgatgacgcagaacaaaatgacggtcacccatgtctggtcaggcgggaagatatggaacgtgtcagggatcggctatgagcctgaaggctctttcagcatgaacgggcgcgatgtgcaagcaaagcatcataaaccgctccagcaggtactattgttcggcgcattatgcaattcatcttcgattatcgaaaaagacggggagtttcgtcttgatggcgatcccaccgaaggggctttgctgacggcggctcgaaaagcaggctttacggacaaatatgttgatgaacattttaaaatcatcgaggagtttccgtttgattcaacgcggaaaatgatgtctgtcattgtggaagacaagagcggcaagcgctttgtcattacaaagggcgcgccggatgtattgatgaagcgttcgtcgcatacgctgacagaagaaaagcgagaaatcttcacaaaggaaaggctcgctgaaacaagcgcggcgctggaaactcttgcgtcacaggcgctgagaacgattgccgtcgcgtataaaccgatcaaagatacagaaaatcccccgctcgaaaaagcggagtcaggcttaactttcatcgggctgttagggatgatcgatccgccgcggcccgaagtgaaaacagcgattaaagaatgccgggaagcggggatcaaaacggtcatgatcaccggggaccatgtgataacggcgacggcgattgcaaaagatctcggattgctgcctccgcgcggaaaggtcatggacggccagatgctgaacgaactctcgcaggaagaattggcggaaattgttgacgatgtttacgtatttgcaagggtgtcgcccgaacataagctgaagatcgtgaccgcctaccaggaaaacggccacatcgtcgccatgacgggagacggagtcaatgatgcccctgcgattaaacaggcggatatcggcatatcgatggggattacgggaacggatgtcgccaaggaggcgtcctcactcatccttgtcgatgataattttgcaacgattaaatcggccatcaaggaaggacgcaatatctatgaaaatattagaaagttcatcagatacttgctcgcatccaatgtcggcgaaattttggtcatgctgtttgcaatgctgctcgctctgccgctgccgcttgtcccgatacagattctgtgggtcaaccttgtaacggacggcctgcctgccatggcgctcggcatggatcagcctgaggacgatgtgatgcagagaaagccgcggagtccgaaagaaggcgtgtgtgcaagggggctcggctggaaggtcgtatcgcgcggattcttaatcggaatcgcgacactcggggcgtttatgttcatttataaccgcaatccagaagcgcttgagtatgcacagacggttgcatttgcaacgctcgtccttgcgcagctgatccacgtgttcgactgccgaagcgagcggtccatctttgaccgcaatccgtttgaaaacatttatttgctcggtgcagtgctgtcttcgattcttttgatgcttgtcgttatttattatccgccgctgcagccgattttccatacggttccgattttaatggcagactggctcctgattgtcggaatgtcggcgattccaacttttttactggccgggtcacttttgacaagaaaaaaataggcttgtatgatataatcttaaaggtaatagaggtttctattgccttttcatcttgcgtaaatttaaatcaaagaaagtctttttcacttatacggaattgggtgtgttttatgatacggagtatgaccggtttcggcagcgcgagcaaaacgaaggatgggctgacagcagctgttgagctgaaatctgtcaactatcggtttaaagaagtaaacgcccgcatgccaagacctttgctctatttagaagacaaaataaagcaaacgatttttaaacatatacaaagggggcggctggagctgtttgtttccgttgacgacgaggctctggtcacccggaaaatccaggttgactggccgctgcttgaagagtaccagaaagccgcgcgcgaaatgaaagaccgctgcgggctttctggagacatcacgcttcaagacgcctttcagtttgagcatgtcatccaagttgaagaagagccaatccaaaatgacaagcttgaagaggttcttctagaagcggtcgaggctgccgttctagaattgtgcagcatgcgcgaagcggaagggctgaggctgaaggacgactgccttcagcatattgaaaggcttgaaaagctgacagacgacatcgcagagcttgctcccaaggtcgtcgaccactatcgggaacgccttgaggcgcggcttgaagaatggtcaacagacggtctcgatgaaagccgcctgctgacggaagtcgcactgtttgcagaccgttcggatatcacggaagaagtgacgaggctgaaaagccatttccgccagttccgcgatatttgcaaagcgggaggagccgcggggagaaagctcgatttcctcgtccaggagctcaaccgtgaagcgaacacgatcggttcaaaagcgaatgatcaccagatcacaaaacatgtggtcgaaatgaaaagctctattgaaaaaataaaagaacaagtgcaaaatatagaatagcgattgtgcgtattgtttacggatgttctctgcaggttaaactagagacgtccaagtacagggggaacgtataggatgacgattaaactgatcaatatcggctttggaaatatcatatccgcgaatcggctgatctcgattgtgagtcctgagtccgcgcctattaagcggatgatccaggatgccagagaccgcggcatgcttatagatgctacatatggaagaagaacccgtgcggttgtcattatggacagtgaccatatcatcttatctgccgtccagcctgagacagtagcacaaaggctttccgttaaagaagaaattatggatgaagggcagggataagagctttatgaaagaaagaggtttgttaatcgttctctccggcccttccggcgtcggaaaaggaacagtcaggcaggcgctgtttgctcaggaggacacaaaatttgaatattcgatttcggtgacgacaagaaaaccgcgtcaaggcgaaagagacggcgtcgactacttttttaagacgcgcgaagagttcgaagagatgatcgagaacaacaagctgctcgaatgggccgaatatgtcggcaactattacggaacacccgttgactacgtcgaacagacgcttgaaagcggaagggacgtttttcttgaaatcgaagtccagggtgcgctgcaagtcagaaaggcatttcctgaaggcttgtttatctttttggcgcctccgagcctcgccgaattgaaaaaccggattgtcacaagagggacagaaacagaagccctgatcgaaaaccggatgaaagcggcgaaggaagaaatcgaactgatggacgcctatgactatgttgtcgaaaatgacagcattgagcttgcgtgcgaaagaatcaaagcaatcgttctcgccgaacatttacggcgcgaccgagttgctccaagatataagaaaatgctggaggttgaataaatatgctagatccgtcaattgactctttaatgaacaaactggattcaaaatacacgctcgttaccgtatccgcacggcgcgcccgcgaaatgcagatgaacaaagacgcgcagatcgaaaatccgaagtcgcataaatttgtaggcaaagcattggaagaaattgatgccggactgcttacattcgaaaaggaaaatcgctaatagccttaaaaatagcaacctatacactaggttgttatttttttcagggctggcgaacagaacataagggggagaaatacgatgctgaaaaatcgcaacatcctgctgggagtaagcggaggaatcgcggtatacaaagcggccgccttaacgagcaagctcgtgcaggcaggagccaatgtgaaagtcatcatgacaaaatccgcctgtgaatttgtgtctccgctcacctttcaggcgctttcgcgcaatgaagtatataccaatacgttcgaagaaccgaatccccgtgtcatcgcccatatcgatgccgcagattgggcggatctcgtgatcgttgctccggctacggccaatgtgatcggaaaactcgcctcaggcatcgctgacgacatgctgacgacgacgcttttggcgacgacagcgccggtgtggatcgctccggcgatgaacgttcatatgtacgaccacccggccgttcagcggaacatcagcgttctttacaaagacggctaccggtttatcgaaccgagtgaaggctaccttgcgtgcggctatatcggcaaaggcagactggaagagcctgagcggatcgtccagttggcagagtcgtatttttcaagcgaaaaaagcggtttgcttgaaggaaagcgcgtcgtaattacagcggggccgacaagagaacaagtcgatcccgtccgctttttctccaaccgttcgacagggaaaatgggctatgctttcgctgaggaagcggcacgaatgggagcgcacgtgacgctgattgcaggcccgacatcgcttgatgatcccgcaggggtcgacgtgattcatgttcagtccgcagaagatatgtatcaagcggctctgtctgttttcgatgagagcgacatcgtcattaaaacagcagctgtcgctgattacaggccaaaacatgtccacgatcaaaaaatgaagaaaaaggacggcggcctcgtcattgagcttgaacggacgaaggatattttaaaagcgctgggagagcggaaaacaaagcaaatcttggtcggctttgcagccgaaacgcagcacgtcgaagactatgccaaacaaaagctggagacgaaaaatctcgatatgattgtcgctaacaatatcacggctgaaggcgccggttttggaacggaaaccaacatcgtgacggtgtttcatcgagacggcaaaaagacggcgcatcctctaatgtcaaagcgggaggttgccgccgcagtcttgaaggaagccgctgagcttgccggatggagcgggacgtcttcatgaacttcgctgaagtgatcgtcgatgttacaacgaaaaatatcgacagaccgtttgattaccgcatccccgacaaattcaaaggtatgattaaaaaagggatgcgcgtgatcgttccgttcggcgcccgcaaaatccagggatttgtcaccagcgtgaaagaatcgtcggagcttgccggccgttcggttaaggatatcgaggatatccttgatctggcgcccgttttgacggaggagctgcttgagctgtcagactggctgacagaaaaaacactttcttttaaaattacggctttgcaggcgatgctccccgcggctatgaaagcaaaatacggcaaagaaatcaaggtgatcggcgataaaccgcttcccgaaccgctaaaaaccttgttctcgcaaaaagagacgctttcttattccgatataaatgaccacggaacattaaagctgattcagcgccaggttcaagaaggcaatcttgaagtggcgtataaagtaaagcagaaaacaaacaaaaaaatgcggagaatgatcgcccccctttgcgcgaaagaacatttaaaagaagcgcttgccggcctctctccgcaagctgtcaaacaaaaagcgatccttcagtttttcatcgaccgcaaagagggcggcgctgttccggcaaaggatctgatcgacaaaacggggggctcttccgcgtccttgaaagcgctcatcgacaaggggctgttaaaggaaagcgaagaggaggtttacagggatccttatcaggacagaatgttcaaaaaaaccgaaccgcttccgctgactgaagagcaggcgcaggcctacgaggcgatagcggatgcaatcgaagaaaagcggcacgatgtgtttcttcttcacggagtgaccggaagcggaaaaacggaagtctatctgcaatcgatcgaaaaggtgctggaagccggcaaagaagcgatcgttctcgttccggaaatttccctgacgccgcagatggtcaaccgctttaaagggcgctttggctcgcaggtagccgtactgcacagcgggctttcaacaggagaaaaatatgatgaatggcggaaaatccaccgcaaagaagtccggcttgtcgtcggggcgcgctcggcgattttcgcgccgtttgaaaatctcggcatgattataattgatgaagagcacgaaacatcgtacaagcaggaggagatgccgagataccatgcgaaagaagcggcgattcaaagggccaaataccaccggtgtccggtcgtgctcggcagtgcgacgccgacgctcgaatcgttcgcgagggcgaaaaaaggcgtgtacaagcttctttctctcaagcaccgcgtcaatcaccaagtcatgcccgacgtgtctctcgtcgatatgagagaggaactgcgcagcggaaaccgctcgatgttttccaaagacttaatggccgggcttgaggaaactcttgaaaaaggagagcaggccgttctgtttttaaacaaaagaggctattcctcatttgtcatgtgcagggactgcggatatgtcatccagtgtcctcattgtgaaatttcattgacgtaccacaggtatggacagcgtctgaagtgccattactgcggctatgaaaccggcatgccgtcaagctgccccgaatgcggaagcgagcatatccgctactttggtacaggcacacagcgggtcgaagaagaattgacgaaggttctgccggctgcaagggtgatccgcatggatgtcgatacaacctcaagaaagggagcgcatgaaaagctgctcacatcctttggcagaggcgaagccgatatcctgcttggaacgcagatgatcgccaaagggctcgatttcgaaaacgtcacgctcgtcggtgtcttgagcgcggatacgatgcttcacatccccgatttcagagccgctgaaaaaacgttccagctgatgacgcaggtgagcggaagagcggggcgccacgaaaagccgggcaaggtgatcattcagacgtacacaccgtcccattacagcattcagctcacaaaaacgcatgattatgaaacattcttccggcaggagatgctgcacagaagggaacaggcctatcctccatattattatttggcgctggtcagcgtatcgcacgaggaagtgacgaaggcggcactcgtgactgaaaaaatcgccacctatttaaaaaagaacatttcaagcgaggcgaagattctcggccctgtcgcatctccgatcgccaggatcaaagatagatatcgctatcaatgcgtgataaaatacaaacaggaaaaccagcttacatcgttgcttaaaaacattatggatcattacaaacgagacattgaacaaaagcaattggcgatttcgatcgacatgaatccatatatgatgatgtaaaaataacagtgtgatggagggcttttagattggcagtaaaaccgatcgtaacgtatccggcggaggttcttgagacccctgccgaacccgttgcgtcttttgataaatcattaaagaaactactcgacaatatgtatgatacgatgcttgagctggacggagtcggactggccgctccgcaaatcggcgtttcaaaaagagcggcagtcgtcgatatcggcgatgacacgggaagaattgaactggtcaacccggaggtcatcgaagagagcggtgaacaaacgggtcctgaaggctgtttgagctttcctgatctatacggtgaagtgaagcgttccgattatgtaaaggtcaaggcgttcgaccgccgcgggaaaccgtttacgattgaagctgagggctttttggcgcgtgcgctgctgcacgaaatcgaccatttggacggtattttattcacatcaaaagtaacgcgctattatgatgcggaagaacttgaggaaatggaaggatgattggatgacaaggatcgtttttatgggaacgccggatttttccgtcccggtgctcggcacattgattgatgacggctatgaggtagtgggtgtcgtcacccagcctgaccgcccgaaaggcagaaaaaaggtgatgactccgccgcctgtcaaggaggaagcgctgcgccgcggcattcccgtgctccagcctgagaaagtgagggaagaagcggaaacggacaagattttggcgcttgaacccgatttaatcgtaacggcggcattcggacagatcctgccgaaaaagctcctcgattatccgaaatacggctgtatcaatgtccatgcctctcttctgccggagctgcgcggaggagccccgatccattacgccattctggaaggcaaagagaaaacaggcgtgacgatcatgtacatggtcgaaaaattggatgcaggcgatatgctcgccaaggttgaagttgacatcgaagaaacagataatgtcggcacgctccacgataagctgagcaaggccggagctgcgcttctttccgaaacggttccgagaatcattgacggttcggtaaccccggaaaaacaggatgaacagaaagcgacatacgcgccgaacattaaacgcgagcaggaactgatcgactggtctaagcccggcgaagtcctgtacaaccaagtcagaggcttgaatccttggcctgtcgcatacacggtcttaaacggccagacgctgaaagtatgggccgcgaaaaaatgccaagccttaaaacaggcagagccgggggagatcgtcaccgttgaaaaagacggcattgtcgtcgcaaccggaaatgacaccgcgttaaaattaacggaagtgcagcctgccggcaaaaaaagaatgaaggctgaagattttgtcaggggagcgggtcttcaagccggaatgaaattgggtcatgacgatgaaaaataatgtgagagaagtcgcgcttgatgcactgattaagcttgaccagaatcaggcatacagcaatcttttgcttcagtctgccatgaaagcgaacgatttaagcgacaaagacagaggccttttgacagaactcgtttacggcacccttcagaataagctggcgcttgattatatgctgaagccgtttattaaaaagccggaaaaggtgaaagactgggtcatccatctgttgagaatgtcgctgtatcagatggaatacctggagaaaatccctgaccgggccgctctttttgaagccgttgaaatcgctaaaagacgcgggcataaaggaatatcttcatttgttaacggtgttctgcgctccgttcagagggaaggagtgccttcctttgcggatattgccgatccgattgaacgccttgcggttgagacaagccatccggagtggcttgtcagagaatggacggatgcctacgggttcgaagcggcagaacaaatctgccggattcatatgatcccgccgaagcagacgatccgcgtcaacaggctgaaaaacgaccgggatacgcttctttcccgtctgaatgaagcggggattgaggcggaagaaggcgacttgtccaaagacgctgtcaaactgctgaaaggaacgattgcgtccactccttttttcaaagaaggcgaagtcaccatacaagatgaaagctcaatgctagtagcgagagcccttggacctgagcggggagaaacagtgctggatgcatgcgcagctccgggaggaaaatccactcatatcggcgaactgctcgaagatacgggaaaggtcgtctccctggaccttcatcagcataaagtaaagctgatcaaagaagcggcaggccggattggactttccaacattgaagcaagagcgctggatgccagaaaagccggagaagtcttcgaaccggaacagttcgaccggatcctcgtcgatgccccgtgttcgggcttcggcgtcatccgcagaaaaccggatctcaaatacagcaaaacgcccgaagacagcgcgcgtctcgccgggattcagcttgcgattttaaacgaaatcgcacctttattgaaaacaggcgggacattggtttacagcacatgcacaatggacccgaccgaaaatgaacaagtcatgcatgcttttttggaagaacacgacgaatttgaagcggaccccaccctcgccgagcggctgcccgaaaaagcggcgccgtatgtcaaggatggaagcattcaaatccttccccactactttggaacggacggcttctttatttgcagcatgagaaagaagggatcacaataatggaatcgaaacaaaaagtaagaaaagaattgcggacagaaagaccgtccatctattcttttgaaatagaagaactgaaaagctggctatcggaaaacggcgagaagccattccgcgccgcgcaaatattcgaatggctatacgaaaagagagtcacgtcatttgaaaagatgacaaacctttcaaaagagctgcggacaaagctgaatgagcatttcgtattaacgacgctgaaaacggccgtcaaacagacttcccaagatggaacaatgaagtttttattcgagcttcatgacggctacacgatcgagaccgtattaatgcggcacgaatatggcaattctgtttgtgtaacgacacaggtgggctgccggatcggctgtacgttctgcgcatcgaccctcggcggcttaaagcggaacctggaagccggagagatcgtcgcacaggttgtcaaagtgcagcaggcgcttgatgaaacagatgaacgcgtcagctcaatcgtcattatgggaatcggcgagccgttcgataattttcaggaaatgcttgcgttcttgaaaatcgtcaaccatgataaaggactgaatatcggagcgcgccatatcaccgtatcaacgagcgggatcattccgaaaatctacgagtttgcagacgaaaagctgcagatcaactttgcgatttctctgcacgcgccgaacactgagatcagaagccggctgatgccgatcaacagagcctacaagctgcccgatctgatgaaagcggtcgattactacattaagaaaaccggcagaagggttacgtttgaatacgggcttttcggcggtgtcaacgatcaggttgaacacgcggaagagctggctgaattgctaaaaggaatcaaatgccacgtcaacttgattccggtcaactatgtacctgaacgagactatgtcagaacaccgaaagaacagattttcgcctttgaaaaaacattaaagtctcatggagtaaatgtcacgatcagaagagagcaaggccatgatattgacgctgcctgcggacagcttcgtgcaaaggagcgccaggaagagacgaggtgaatcaaggttgaaaacagccttaaaaacggacaggggaaaaatacgccagcacaatgaagacgatgccggcattttcacagaaaaaaatggactggtattagctgttgtctgcgatggaatgggaggtcatctggccggcgatgtcgccagcaggatggccgtctcagcccttcgtgatatttgggaggaaaccgaagaagtcccggcttcgccggctgaaagcgaagcgtggctgaaagagcagatttcagccgtcaaccaaaaacttttcgaccattcgagggcccacgaagagtgccagggaatggggacaacggtcgtctgcgctttatacacgggaaaaacgctgacggtcgcccatatcggagacagccgctgctatctcctgcaaggcggaagtttcatacagctgacggaagatcactcgcttgtcaatgaactcgtgcggactggggggatttcgaaggaggatgctgaacaccatccgcggaaaaacgtgctcacaaaagctctcggcacagatcccgaagtgaaggtagaagcccacacatttgaaatcgaaccgggtgatcaagtgctattatgttctgacgggctgacgaataaagtggatgatgagacactgaaggatatgctcacgactctttcttctgcggaggagaaagcggatcagctcgttcagctggccaatgacaacggcggcgaagacaatatcaccgtcgcgctattggaacttccttctcaaattgaagaaggtgaagacaagtgttaatcggcagacggatcagcggacgttacgaaatcctgcgcgccatcggcggcggggggatggcgaacgtttatttagcgctggacatcatcctcgaccgtgaagtcgcgattaaagtgctgcggtttgacttcgttcacgatgccgattttatcaggcggttcagacgggaagcgcagtccgctgcaagcctcgaccacccgaatatcgtcagcatttatgatgtcggagaagaagatgacatctattatatcgtgatggagtatgtcgaggggatgaccctgaaagaatacataaatcgaacaggcccacttcatccgaaagaagcggtccaaatcatggagcagatcgtatccgccatcgcacatgcccatgataaccagattgtccaccgggatattaagccccacaacattttgatcgaccatatgggccacattaaagtgactgatttcggcatcgccatggcgctcagctcgacgaccatcacgcacaccaactcggttttgggctctgtccattatttgtcgcccgaacaggcgagaggcggattatcgacgaaaaaatccgatatctactcgctcggcatcgtgcttttcgagctgctgacggcgcgtatgccgtttgaaggagaatcggcggtcagcatcgcgctgaaacatctccaatcagaaacgccgtcggtgaaaagatggaacccggccgtgccgcaaagcatagaaaacgtcgtcctgaaagcgatggcaaaagatccattccatcgctatgaagcggccgaagagatggaaaacgatttgaaaacggctttcgacccggaccggctcaacgaaaagcgcttcacgattccatccgatgatgagatgacgaaagcagttccgatcatcaagaatctgccggaaaacgggagcagctcgcaatccggcggcggagaagaggaagcggctccattatcaaaaaaagaaaagaagaagcaggcaaaagcaaacaagaagaaaaaaagaaagaaatggccgcttatattgctgacggtgtttttcgttctggctgcgtcagccgtcttggctttaacggtgtttccgtcgctctttattccgaaagatgtggccgttcccgatgttgccggccttgaatatgaagaagccgtcatcaagcttgaagacgaaggatttgaagttgatccgaatgctgaagacattgccgacgataaaattgaagaagggctgatcgtgaagacggaccctgcagccggcgatatcgtgaaggaaggttcaactgtcaagctatataaaagctcaggcaaagagaaaactgaagtcgatgatgtggtcggccagaaagtcgatgccgccaagaagcttcttgagcaaaaaggctttaaaaacatcaagacagaagaagtgcacgatgaagaagaagcgggaaccatcatcgaacaggaccctgcagccggaaccgaaatcgttgccgccgacgacgaggtcaaattaacggtcagcctcggtccggaagccattactttaagggatttaaaaacatacagcaaacaggcggcttcgggctatttggacgaccatcagcttgtccttgtcgaaaaggaggcgcattctgaagacgtgccggaaggtcaggtcattaaacaaaagccggaggcgggggcatcagtcaagccgggagacaaagtcgaggtcacgttttcgctcggacctaaacaaaagcccgtcaaaacggtgaccgagaaaattgatattccttatgaaccgggagcggcgggcgaagaacaaaacgtccaaatttcgatcgatgatgaagaacacagcatttctgacgtctacgaaaatttcaaaatcacagcgccggcagagcggacgatcaaattcaggattgcgcccggccaaaaagggtattatcaagtaacgatcaacgataaagtagtcaggtcaaaaacgattgaatatcctgaggatgaataagggaggtgcgatatgcctgagggcaaaatcattaaagcattaagtggattttactatgtattggatggcgatcaggtcattcagtgcagaggaagaggggtttttagaaaaaataaagtaacccctctcgtcggcgacgatgttgtctaccaagccgataacgataaggaaggctacattctcgagattaaagacagattcaatgaattggtcagacctccgatcagcaacgtggatcaggcggttctcgtgttttcggcaaaggagccgacattcagcacgtcgcttttggatcgttttttagtgctggttgaggcgggtgatattaggccgatcatatgcatcacgaaaatggaccttgtggatgatgacgcgctgaaagagcagattcatcaatatgccgaagactaccggaacatcgggtacagcgtctatttgacatcaatgaaaagcggaagaggcatcgaagacatcatcccccattttcaggataaaatcaccgtattcgccggccagtccggcgtgggcaagtcttcgcttttaaatgcgatcagccctgaccttgaactgaaaaccgccgggatttccgcccacttgggaaggggaaaacatacgacgcgccatgtggagctgatcgatataaacggcgggctcgtcgcggacaccccgggcttcagctcgcttgagtttgccggtattgaagctgaagatttagggcagacatttttggaaatcggcgaaaagagcgccgaatgcaagttccgcggatgcctgcatataaaagaaccgaactgcgccgtcaaacgcgccgtggaaaacggtgaaatcgcccagtatcgctacaaccattatgttgaatttttaacagagatcaaagatagaaagccgaggtattaagatatggtatatgttgctccttctattctttcagccgattttgcccgtctaggggaggaaattcgagatgttgaacaaggcggcgccgatttcatccacatcgatgtgatggacggccatttcgttcccaacctgaccatcgggccgcttgtagtggaagccgtccgcccgatcactgagcttccgctcgacgttcatttaatgatcgaagcgcctgaccgctatatacctgcttttgcaaaagcgggcgccgatattttgtccgtccatgttgaagcatgcccgcaccttcacaggacgatccagctcatcaaagagcaaggggtcaaagcgggagtcgtcttgaatccgcatacccctgtgcagcagatcgagcatgtgcttgaagaccttgatctcgtattattgatgacggtgaatccgggcttcggcggacagtcgtttatttcctcggtcctgccgaaaatcaggcaggtcaaggagatggctgagcaaaaaggacttgccgatctgctgattgaagtggacggtggcgtcaacaaaaatacggcaagacagtgtattgaagcgggagcgaacctgcttgtcgcaggatctgccgtttataacgaaaaagaccgcaaaaaagccatttccgatataaaaggtgcgcttgggtaaggtttcctgatgaaagagagccggctttctgcagctgcgctctttttttagggcgttcacagaaaggataatgcgatgaaaacgatcaatattgtagcgggaggccccgatcatcttattcccgacttgctgcagtatcaggccggggatgcgctttgggtcggggttgacagaggcgctgtcacccttttggatgcggggatcgtgcctgatgaagcattcggggattttgacagcatcacagacgagcaaaaaaaagcgattgaaaaggccgctccccgcctccatatttatcaggcggaaaaagatcagacggatttggaccttgcgttgagctgggctgtcggacagcgtccttcatttattagaatgttcggcatttcgggaggcagagcagaccattttctcgggaatctgcaccttctttataccgcgatgaagcaaaacgtcaagaccgtcatgatcgaccgccaaaatacgatcagcatgcatcccccaggctcctataccgtcatgcatgatcaaacaaaaccgtatatttcattcctgccgtttgcggagacggtaaaaaacctttctctcgaaggatttaagtattctttaaataagtgtcatattgctctcggttcgacactatgtattagtaacgaactcatccattcacaaggtgctttttcgttttcagaaggcatattaataatgataagaagcactgattaaatatcctggcgcttccgctcgctttgtgtttgggatccgatgttgaaggtggatgcggttgcggactctttgaggagggaagggaatgaaattttacaccatcaaattaccgaagtttttagggggaatcgtccgggcgatgcttggctcgtttcgcaaagactaagaagcgccgggtgcgctttttttgcggagcggcccggatggcaaaagaacgaaaaaacgcctgcctaaagcgtacagtcgctcttggcaggcgtttattttttcttatacacgctcaacttttccagatttcaaagctcgagcagatacatatacttttttaggcttgccgttcacaaggatgcgcactttttgaacgttagcgccccatgtgcgtttagaagcgttcatcgcgtgagaacgagagttgccagaacgtgattttctgcctgtaataacgcatttacgtgccatttgtttccctcctaactatcaaaaaaaacatcatcattctttatcagttgatcacctgtgatgcttcagatactttaataatttaccacagctgaaaaccgtttgcaactattgattgctctgctttcaagaaaaattccttgacatcttgaaaaaatgaacgcgctgtagtataagtagggttaggtttggagagaagcctgcctgttcttttaaaaagaaggtccttatagtagaatgatttataaccagaggtcaaaagcgagactcgaaaaggaggaaccaacgtgtccattgaattccgaacaaaatacggacagattgatatatcaaacgaagtggtcgccatggttgcaggaggcgcagcgatcgactgctacgggatcgtaggtatggcatccaagaaccaaattaaagacggactgactgaaatcctcagaaaagaaaactttgcaagaggcgtcatcgtccgccaggaagaggatcgtattcatattgacatgtacatcattgtcagctacggaacaaaaatttcagaagtggcacataatgttcaaacaaaagtcaaatatacgctcgaccatacagtgggtcttgcagtggattccgtaaatatttacgttcaaggagtacgagtgacgaacccgtagttaggaggaaaacaagagtgtctatacgaaatctggatggaaaagcttttgcagatatgattctgtacggcgcacaccatctgtctcaaaacgcaaatgtagttgatgcgttaaacgtatttccggttccggacggagatacgggaacgaacatgaatctgtcgatgacatccggtgcgaaagaagtggagcaaatcgacaccgccaatatcggcaaagtggcacaaagcctgtcaagggggcttctgatgggggcgcggggaaactcgggcgtcattttatcccagctgttcagaggctttggcaaatcgattgaacagaaatcggaaattaacgcgaaagaatttgccgccgcgttccaggccggagtggacaccgcctacaaggccgtcatgaaaccggtcgaaggcacgatcttgacggttgccaaagatgccgcaaaaaaagcagtgctcgccgctcaaactgaaaccaatatcatcaaggtgatggaagctgtcgtaaatgaagcggaggcttctttggagcggacgcctgagctgcttccggttttaaaggaagtcggtgtcgtcgacagcggcggaaaagggcttctttacgtgtatgaagggtttctcgcttctttaaagggagaaaagctttctgataaagcggcagctcttccgtcattggatgaccttgtcagcgccgagcaccataaaaacgctcaaagccacatgaatactgaagacatcgaattcggctactgcacggagtttatggtaaagctcgacagcggcaaaagaaactttaatgaagatgcgttccgccaggatttaagccgcttcggtgattcgcttctcgtcgtctcagacgaaaatatcgccaaggtgcacatccatgccgaatatccaggggaagtcatgacttacgcgcaaaaatacggcagcttaatcaacatgaaaatcgaaaatatgagagaacagcacagcgcgattctcagccagaacaaacaggagacagcaccggcagaaaaagcgccggcagataaacagccgtacggcatcgtcacagtggccatgggtgaagggattgccgagcttttcgaaagcatcggcgccacaaaggtcatagaaggcggccagacgatgaatccgagcacggaagacatcgttcaggcgataaaagacgccaatgcggacacggtcgtgattctgccgaataattcaaacattgtcatggcggcgaaccaggccgcggatgttgccggacaacatgtaattgtcatcccgacgaagaccgttcctcaaggaatggccgcactgctcgcattcaacccggccctttcagcggacgagaatgaagccgctatgctcggtgcgatcggcgaggtgaaaagcggacagatcacctatgcggtcagagacacaaacattgacggcatcgatattaaaaaaggcgattttatgggcatattaaacgggaaaatcgttgagacggcgtcagaccagttaacagcagcgaaaaagctgatcgcaggcatgatcgatgaagacagcgaaatcgtcaccgtgatcaaaggggaagacgccccggaagaagaggccgaagaactcgcagcctacatcagcgagacgtacgaagacgtcgaagtagaagtgcacgacggaaaacagccgctgtattcctacattctggctgtcgaataacgaatcaaaggcagaagggcatgttgataaaagcccttctcttcttttggctttttttaaagcctcagcccgcaacggacgttgtctgcttgccaattgggaaatgatcgattagtctaaaaaaaaacggctttttttcctccgtacagcgggggaatctgtttgtaaaagggggataaggatgaagtacagaagtgtgtttgatattatcgggcccgtcatgatcggaccgtcaagttctcatacggccggcgcggccagaatcggcagagtcgccagaagcgtgtttgggagggagccgaaacaaattattgtatcgctctacggttcttttgccgaaacgtataaaggacatggaacagatgttgcgatcatcggcggccttttggattttgatacatttgatgaaagaatcaaagattcgatccgtctagccgaagaaaagggaatcgccatcgagttccgggaagaagaagcggtaccgaagcatcccaatacagcccgcatcctcatctctgatgatgaaggctcccttgaactcgcaggcatctcaatcggcggagggaaaatcgagatcattgagctgaacggcttcgaactcagattatcgggtaatcaccccgctattttagtcgtccataacgaccgctacggaacgattgcaggcgtagccaatgtgcttgcgaagttcgcaatcaacatcggccatatggaagttgcccgcaaagacgtcggccaggaagcgctcatgacgattgaggtcgatcaaacgattgatccggctgtttttgatgaattgagagcgctgccgaacatcattgaggtgacccagatcgctgactaaaaaggagggtgagacgatatgtttcgaaatgtgaaagaattaattcaactgacaaaggaaaagaacgtgtccatctctgaaatcatgatcacacaggagatcgaggtgacaggccggacgcgggaagatatattcaagcagatggaagccaacttggctgtcatggaagacgctgttcaaaaaggcattgagggcgtcgtatcgcactccggattgacgggcggagacgccgttaagcttcaggcctaccttaaatcgggcaaagggctgtcaggggatgtcatccttgacgctgtcagcaaagcggtagcgacaaatgaagtcaacgctgcgatgggaacgatttgcgcaacgccgacagccggatcggccggcgttgtcccggggacgctctttgcggtaaaagagaaacttcacccgacgaaagagcagatggtccgctttttatttacatcgggagcgttcggattcgtcgttgccaacaatgcgagcatttcgggagccgccggaggctgtcaggctgaagtcggatcggcctcgggcatggcggctgccgccatcgtcgaaatggcgggcggaacccctgaacagtgcgccgaagcgatggccatcgctttaaaaaacgtactcggtctagtctgcgatcctgtcgcagggctcgttgaggtgccgtgtgtgaagcggaacgcgatgggcgcagccaatgcgatggtcgcggctgatatggcgcttgccggcattacaagccgcattccatgcgatgaagtgatcgatgcgatgtacaaaatcggacagacgatgccgacggcactgagggaaacaggccggggcggtcttgccgcaacaccgacgggcaaagaattggagaaaaaaatattcggaggagcgtcagctgcacgtggaacacaatctgcaacttagtatatctgttataaaaggcgtcgggacggaaacggaaaaaacgttgaacgagctcggaatctatacggttctcgatcttttaaactacttcccgtaccgatatgacgattatgaattgcgcgatttggaagatgtggcacacgatgaacgagtgacggtggaagggaaggttcacagcgagccttctcttgcctattacgggaaaaagcggagccgtctcacgttccggcttttggtcgggaactatttgatcacagcggtttgctttaacaggccttatttgaaaaaaaagcttgcgatcggctcgattgttaccgtaaccggaaaatgggacaagcacagacaatccgtgatggtgcaagagctgaaaaacgggccgcaccagggtgatcagtcgattgaacccgtatactccgtcaaagaaaacatcaccgtaaagacgatgaggaaattgattcaggaagctgtccgcagccatttgccgtttgccgaagatcctcttccggaaaagcttcggaccgcctacaaacttctgtcttaccaggaggcggtaaaggcgatgcacaagcccgagtcgagggaagctttaaagcatgcgcggcgccgttttgtatatgaggaatttttgctgtttcagctgaaaatgcaggctttgcgaaagttcgagcgggaagcgtccgacggaatcagccacacctttcggctcgaagacgtcaattcgtttgtcaaaagccttccgtttcctttgacaaacgcgcaggcgaaagcgctcgacgacatattaagggacatggcttcagggtataaaatgaatcggcttttgcaaggagacgtcggttcaggcaaaacagccgtcgccgcgattgcgctatacgcctcgctgctttccggattccagggggcgatgatggttccgaccgaaatactggcggaacagcacgccgattcgcttgtatccctctttgagcagcacgacgtcaatgtggcgcttttaacaagctctgtgaaagggaaaaggagaagagagcttttagaaagattaaaagaaggagaaattgatattttggtggggacgcacgcccttattcaggacgatgtccactttaaacagctcgggctcgtgatcaccgatgaacagcaccgcttcggcgtcgagcaaagaaaaaaactgagaagcaaagggaaagatcccgatgtcttgtttatgacggcgacgccgattccgagaacactggcgatcacggttttcggggaaatggatgtgtccgtcatcgatgaaatgccggctgggcgaaagcggatcgagacgtattgggtaaagcacgacatgctcgaacggattctcgcgtttatcgataaagaactgaaaaaaggcagacaggcgtatgtgatctgtcccttgattgaagagtcggacaagctcgacgttcaaaatgcaattgatgtgcacagcatgctgactcatgccttcaggggaagatggcagatcggtctcatgcacggaaagctgtcaaatgacgagaaagaacaggtaatgaggcagttcagcaaaaacgaatgccagattctcgtttccacaaccgtcgttgaagtcggggtaaacgttccgaatgcgacggtcatgctgatctatgatgccgaccggttcggtctttcccagctgcatcagcttcgcggccgggtcggacggggcgatcaccagtcgtattgcatcctgatggcagacccgaaatctgagacgggaaaagagcgcatgagcatcatgtctgagacgacggacggctttgagctttctgaaaaagatcttgaactcagagggcccggggactttttcggcaagaaacagagcgggatgccggagtttaaagtcgccgacatggttcacgactaccgcgcgctggaaacggcaagaagagacgctgcagaacttgtctcttcaaaagcgttctggacggatgccgaatataaaagcctgcgggaacacttgcaaaacagcggggttatggacggagaaaagctgagctgatctgaagtccagctaaaatttatcgtcggcgggtaaagaaagattgcattccaatctatgaaattatatactactattagtacctagtcataattgcgcggatggtgtttaataacatgagaaaaagtaagagagaacgccaagaattgctgcagcagacgattcgtacgaccccgtttattacggacgaggagttagcggagaaatttaacgtcagcattcagacgattcgcttggaccgtttggaactttccatacctgaactgagagaaagaatcaaaagtgttgccgagaagtctcttgaagatgaagtcaagtcattgccgcttgacgaggtcatcggcgagatcattgatttggagctggatgagcacgcgatttcaattcttgagatcagaagggagcatgttttcagccgaaatcaaatcgccagggggcaccatttgtttgcccaggccaactcgctcgccgtcgccctcatcgacgatgagctcgcattgacggccaaagcggacatccgctttacaaggcaggtcaagcaaggcgaacgggtcgttgcaaaagcgaaagtcgtgaagcttgataaagataaaggcagaacggttgttgaagtgaacagctatgttgccgaagagcctgtgttttcaggcgaatttgtcatgtatcgttcaaaacaatcatagaaggtggcgcgtaagtcatgaaaattgctgtagatgccatgggaggagacaatgctcccaaagcggttattgaaggcgtgatgaaagcggtcgaagattttgaagacctcgagatcacgctgatcggcgaccgggaaaaaatagccgcccatttaacagaacacgggcggatcaccgtcaaacacgcggaagaagtcatcgaagcgacagacgagccagtcagagccgtcagaagaaagaagaattcatcgatggttctgatggccggagaagtcgccgaaggcagggctgatgcctgcatttccgccggaaacaccggagcgcttatgacggccgggctctttatcgtcggccggattgaagggattgaaaggcctgcgttggcaccgacattgccgaccgtctccggagacggctttctccttcttgatgtcggagcgaatgtggacgccaagcccgaacatctcgttcaatacgccattatgggatctgtttacggagaacaggtgctgggcgtcaaaaatccgcgcatcggacttttgaacgtcggaaccgaagataaaaaaggaaatgagcttgccaagcagacctttcaaaaattgaaggaaaccgatttgaatttcatcggcaatgtggaagcccgcgatatgctggacggagtcgctgatgtcatcgtcacagacggctttaccggtaacgttgccttgaaaacggtcgagggcgcggcgctgtccatttttaaaatgctgagaacgacgctgacttcgagcttcacggcgaagctcgccgcttctgcactgaagccgaagctgaaagaaatgaaaacgaaaatggattactctgaatacggcggagccggattgttcggcttaaaggcgcccgtcatcaaagcgcacggatcatctgacggacgcgccgtttatcacgcgatccgccaggccagagagatggtcagccaaaatgtcgcggcatttatcgaagaaaaaattcaacaaaaagcagatgaatagtctggaggttttaacacatgggcaagattgcttttctattcccgggccaaggttcgcagcatatcggcatgggacacgaattgtatgaaaaagaaccgaatgcgaagaagatttttgaagaagcggatcaaacgcttgaaacaaaactgagcaccctcatgtttgaaggggatgcaaaggaactgacgcttacatacaacgcgcagccaagccttttaacggcgagcatcgcagcgcttgaaaaactgaaggaatacggcattaaagccgactatgcggcaggtcacagcctcggcgaatacagcgcattggtcgctgccggcgccttgtcgtttaaagatgcggtttatgccgtcagaaagcgcggcgaattcatgaatgaagccgtgccggcgggagaaggcgcgatggcggccattctcggcatggacagccaggcgctgaaagaagtgacggacaaaatttccgaagaaggaaaccttgttcagctcgccaatttgaactgccctgggcaaatcgtcatctcgggaacagctaaaggcgtggagctcgcttcagagcttgcgaaagaaaagggcgcaaaacgcgcgattcctctcgaagtcagcgggccgttccattctgagctgatgaagccggcagctgataagcttcgtgaagttcttgatgcgtgcacgatcaacgacgcagccattccggtcgtctccaacgtaacggccgactttgtaacggataaagacgacattaagaataaactgattgaacagctgtattcccctgtacgctttgaagaaacaatcagccgcctgattgacgaaggcgtcacgaccttcattgaaatcggtcccggaaaggttttgtcagggcttgtgaagaaagtgaaccgcagagtcaaaacgattgctgtatcagacccgaacacaattgaacttgccgttcaaacgttgaaggaggaaaacgaaaatgctggaaaataaaacagccgttgtgacaggagcctcaagaggaatcggccgcgcgatcgccctggacctggcgaaaaacggagcaaatgtcgtcgtcaactacgcgggaaatgaagcgaaagcgaacgaagtcgtagacgaaatcaaagcgctcggccgcgatgcgtttgcttttaaagcggacgtttccaatgcggatgaggttcaggcgatgatgaaggaagcggtcggacgcttcggcacgcttgacatccttgtcaacaatgcgggcattactaaagacaatctgttcatgagaatgaaagaagatgaatgggacgacgtcattaacataaacttaaaaggtgtgttcaattgttcaaaagctgtgacaagacagatgatgaaacaaagaagcggccggatcatcaatatcacctcggttgtaggcgtcgtcggtaacgccgggcaggccaactatgtcgcggctaaatcaggcgtgatcggcttgacgaaaacgctggcaaaagaactggcgtcaagaaacatcactgtgaatgcgatcgctccgggattcatttcgacggaaatgacggacaagctgacaaaagacattcaagacgaaatgctgaagcagattccgcttgcgcggttcggcgagccgtctgacatcagcagcgccgttgttttcctcgcatctgaccatgcgagctacatgaccggccagacgctgaacatcaacggcggaatggctatggtttaaacgaaatcaaaaattgaattatctctggttttttaaaaacgaatcaactataatacttgaggggaggtgaatagctatggcagacgcattagagcgtgtaacaaaaatcatcgtagaccgcctcggcgtggatgaagctgacgtcactcttgaagcttcttttaaagaggatttaggcgctgattccctggatgtagttgagcttgtcatggaacttgaagacgagtttgatatggagatttctgacgaagatgctgaaaagattgcaacagtcggtgacgctgtgaactacataaatagtaagcagtaagctcatttaaagtcccgtttaaagacggggctttatccctttataaatgcggctttaattttaatgttttgcccaatgataaacgaacctgccttttcataggaggtgaggtgaacttgatgtgcccatatggaggttgctatgtcaaaacattcacatttcagagacaaaaaaatgtttcaaaaaaaagcggagcagtttaaaaagtttcaggaacggatttcggttcaatttcaaaacgagaagcttttatatcaagcgtttacacattcatcttatgtgaatgagcatcgaaagaagccatatgaagataatgagaggcttgaatttttaggagacgccgttttggaactgacgatttctcaatttttatacgccaaatacccggcgatgagcgagggtgatttgacgaaattgagagcggcgatcgtatgcgagccttctttggtttccctggcccatgagctttctttcggagagcttgttctattgggaaaaggagaggaaatgactggaggaagaaagcgtccggcgcttttagccgatgtgtttgaagcttttatcggtgcgctctatctggatcaggggctcgaagccgtcgtgacttttctgaaagcgtacgttttccctaaaatcgacgatggtgctttttctcatgtgatggattttaaaagccagctgcaggaatttgtacagcgcgacgggcgaggcatactggagtataaaatccttcaggaaaaaggaccggcgcacaaccgcgaatttgaagcaaatgtatcgctaaaaggagaagtacttggggtgggaagcggccgttccaaaaaagaagctgaacagcatgccgctcaagaagcgctcgcgaagctgcaaaaacaccatatgaaacaataaatcccccttgcaaaaaccagggggatttcaatgtattttgagccttttccatagggttatgatagaattgtaatactttaatacataaggaggatcaccatgttcctcaaacgtttagacgtgataggatttaaatcgtttgcagaacgaatttctgtagattttgtaaaaggcgtgacagccgtcgtcggcccgaacggcagcggaaaaagcaacatcaccgacgcgatccgctgggtgctcggtgaacagtccgccaaatcgctcaggggcggcaagatggaagatatcatttttgccggcagcgactcgcggaaaaagctgaaccttgccgaagtgacgctgacgcttgacaacgatgaccgctttttgccgatcgattttcacgaagtcagtgtgacgagaagagtctacagatcgggggaaagcgaatttctcatcaacaaccagccgtgccgcctgaaagatatcatcgatctttttatggattcagggcttggaaaagaagcgttttccatcatcagccaaggcaaagtcgaagagattttaagcagcaaggctgaagagcggagaagcatcttcgaagaagcggccggcgtattaaaatacaaaacgagaaagaaaaaagccgaaaacaagctgtttgagacacaggacaatttgaaccgggtcgaagacatcctccacgagctcgagggacaggtggagccgctgaaagtgcaggcatcgatcgccaaagactaccttgaaaagaaggatgagcttgaaaaaatcgaaatcgcgttaacggcgtatgacatcgaagagcttcacggaaaatgggaagcccttcagcaaaaagtcgaaaaggcgaaagacgaagaaatgtcctcttctgcggccatccaggcaaaagaagccaaaatcgaagaggcaagagacaaaattcaagcgctcgacgaatcggtcgatgagcttcagcaagtgctgcttttgacaagcgaggaactggagaagcttgaaggccggaaagaagtgctgaaggaacgcaaaaaaaacgccacgcaaaacagagctcagcttgaagaagcgatcgtccagcgcagtgaaaaagagcgaaccctgaaagagaaaatcgccgcgcagaagcttgtgtttgaaaagctcgagactgaagcaaaagagcttgcccgacaggtgaaagaaaaaaatcaggctttatccggatacagcgaaaatgtagaggaagaaatcgaacagctgaaaagcgattatttcgagctgttgaacgaacaggcttccgtccgcaacgagcttcaatttcttgaagaccaaatgacccaatctgcggcacagcagaaacggctcgcacaaaacaatgaaaaatatttaagcgagcggaaggaaatcgccgaccaaaagatgaaaaccgaacacgaattcagcctcgtggacgagcgtcttcacagccagattcaagcattcagggacgcgcaaaaaagctatgaacagaaaaaaagccagtacgaaaaaaaggaatccgccctttaccaggcttatcaatacgttcagcaggcgcgctctaaaaaggaaatgcttgaagcgatgcaggaggacttttcggggttttatcaaggcgtcaaagaagtattaaaggccaagagcgagcttccgggaattcgcggcgcgattgcagagctgttaaagacggacgagcggtatgaaacagcgatcgaaatcgcgctcggcgcaacagcacagcatgttgtcacagaagatgaagacgccgccagacgggcgattcaatatttgaaaaagcattcgttcggaagggcgaccttcctcccgctttccgtcatcaaagagcgccgcatccagccgagagacatcgagacggcgaaagaaaacccgtcgttcatcggcatcgccagcgagcttgtttcatttgatccggcctaccggagcgtcgtgcaaaatctgctcggcaccgtgctgatcaccgagcatttaaagggcgccaacgaccttgccaagcggctcggccacagataccggatcgtcacccttgaaggggatgtcgtcaatccgggcggttccatgacgggaggagctgtcaagaaaaaaagcagctcgcttctgggacgaaacagggaactggaagcccagacaaaacgcctcgccgagatggaagaaaaaaccgaattgctcgaaaaagaagtgaaagccctgaagcagaccattcaggagcttgatgccaagctacagtcacttcgggaggacggagaacgcctaagatccgagcagcaggaaatcaaaggccgtctgtacgaactcgaaatcgccgagaaaaacgtcaacagccatttggagctctatgaccaggaaaaatcggctctgcttgaaggggacgaagacaagaagtggcgtaaagaagagcttgaagaaaagctcgcatcgatcgccggcgagctgcagcgccttgattccgaaatcgaagccatgacggagcggaaacagacgcagacctcgacgaaagaagcgttgcaaagcgagctgaccgatttgaaagtggtgctggcgaaaaccgaacagtcgtgtgcaaacgaacgggaaaagctcgcaaggcttgaagaagagtatgccgagaatgcggaagcgctcaaggtggccgaagaggatctttctttcttaacgacagagatgtcctccaattcttccggtgaggaaaaacttgaagaagctgcgaaaaagaagctgaacgataaaaataaaaccgcagagctcatcgcctcaagaagagaacagcggatgaagctgcaaaaaggccttgaaaccgaagagctcgaactgaaagaaatgaagcgccagtataagcagatggccggtctcttaaaagatgaagaagtcaagctcggccgcatggaagtcgagctcgacaacctgctctctttcctgcgggaagagtacggcctttcatttgaaggggcaagggaaaaatatcctttggagctttcccctgaagaagcgaggaagcgcgtcaagctgatcaagcttgcgatcgaagagctgggaacggtgaaccttggcagcattgaggaattcgaaagggtcaatgaacgctacctcttcctttcagagcagaaagacgacctgctcgaagcgaaaaatacgctctttaaggtcatcgaggaaatggatgaggaaatgacgaagcgttttgcggaaacatttgcgcagatcagctcccattttgaagacgtcttccgggcgctgttcggcggcggaagagccgagctcaagctgacagatccgaatgacctgctccaatcgggcgtcgatattatcgcccagcctccgggcaaaaagctgcagaacctgagcctgctttccggcggggaacgggccttgacggcgatcgcgctcctgttttcgatcctcaaagtcagaccggttccgttctgcgtgctggatgaagtcgaggcggcccttgatgaagcgaacgtgttccgctttgcccaatacttgaaaaaatacagccatgaaacccagttcatcgtcatcacccaccggaaaggaacaatggaagaagccgatgttctttacggcgtgacgatgcaggaatcaggcgtttccaagctggtctcagtcaagcttgaagaaacaaaagaattagttcaataaagcgaggttacaggacatgagcttttttaaaaaactgaaagaaaaaatcacacagcagaccgattcggtctcaggcaaatttaaagaaggcctggcgaaaacgagaaatacgtttcaggagcgggtcaatgagcttgtctcccgctaccggaaagtggacgaggatttttttgaagagcttgaagaggttctgatcggcgctgatgtcggcgttgcgactgttatggagctgattgacgagctgaagagcgaggtcaagcgaagaaatattcaggacccgaaagaggtgcagtccgtcatttctgaaaagctcgttgaaatctatgaaggcggggagcaggaagcatcagagctccgcgtcgaagacggccgcctaaacatcattttattcgtcggcgtcaacggcgtcggcaaaacgacgacgatcggcaagcttgcccatcaattcattaaagaaggcaaaaatgtcgttcttgctgccggagatacattcagggccggcgcgatcgaccagcttgaagtgtggggagagcgcgtcggcgcgcatgtcgtcaaacaggcggaaggctcggatcctgcggctgttatctatgacgccgttcaagccgcgaaagcgcgcggcgccgatgtcctgctttgcgacacggcaggacgcctgcaaaataaagtgaacttaatgaaagagctagaaaaggtaaagcgcgtgattcagcgcgaagtgcctgatgcgcctcatgaagtgctgctcgtactggatgcgacgacagggcagaacgcaatgacacaggcgcgcgaattttccaaagcgactgatgtctcaggcatcgtgctgacgaagctcgacggaacggcaaaaggcggcatcgtcctcgccatccgccatgagctgcagattccggtcaagtttgtcgggctgggggaaaaaatggatgacctgcagccgtttgaagcagagtcatatgtatacggcctgttttccgatctgatcgagaaagaagagtaggcgcggaaaacccctttgcgggggttttcttttttgccgtccggtatgacaagataaaaacttgacagatcaaatatttcagcgtaaactagtgtatcgtaaagggatttgacttaacaaaggggagagtctcatgacgcttgaaaaaacaacgagaatgaattacttattcgatttctatcagacgttgttgacatcaaaacaaaaaagctacatgtcgctttactacttagacgatttctcccttggcgaaatagctgaagaatatcatgtctcaaggcaggcggtctatgacaatatcaaacggaccgaagccatgcttgagcaatatgaagaaaagctacttttgtttaaaaaatttcaagagcgcaaaaagatttttgaagcgctgagaaagctgactgacggtcagcctgaggcggagtccctgattgatgcgcttgagaaattagattaggaggcggcacttaatatggcattcgaaggattagccgaccgactgcagcaaacgatctcaaaaatccgcggaaaaggaaaggtaacggagcaagacgtcaaagagatgatgcgcgaagtccgtttagcgctccttgaagcggacgtcaattttaaagtcgtgaaagattttgtgaaaaaggtaagcgaacgagctgtcggacaagacgttatgaaaagcctgacgcccggacagcaggtcattaaagtggtaaaagaagagctgacggagctgatgggcggcgaggaaagcaagattgccgctgcaaagcgtccgccgaccgtcatcatgatggtcggtctgcaaggggccggtaaaacgacgtcgaccggaaagcttgccaacctgcttcgcaaaaaacataaccgcaatccgctgctcgtggcagcagacatctaccgcccggcggcgatcaaacagctggaaacgctcggcaagcagctcgatatgccggtattttcactgggtgacaaggtcagtccggtggagattgccaagcaggccatcgaaaaggcgaaagaagatcatcacgactacgttctcatcgatacggcgggacgccttcatattgatgaagagctgatggatgagcttgagcaggtaaaagaaaccgctcagccggaagagattttccttgtcgttgactccatgacgggtcaagacgcggtcaatgttgccaaaagctttaacgaacagctcggtgtgacaggtgtcatcttgacgaagcttgacggcgatactagaggcggagcggccttgtcaatccgcgccgtgacaaacacgccgatcaaattcgccggaatgggcgaaaagcttgatgcgctggagccgtttcatcctgaacggatggcttcgcggatactcggaatgggcgatgtgctcacccttatcgagaaagcccaggccaacgtagacgaagaaaaggcgaaggaactcgagcaaaaaatgaaaaatatgagctttacgctcgacgactttttggaacagctcggacaggtccgcaatatggggccgcttgaagacctgattcaaatgatgcccggcgcaggcaaaatgaaaggcttaaaaaacgtgaaggttgatgaaaaacagctcagccatatcgaagcgatcatcaagtcgatgaccgggaaggaaaaagagcagcctgagatcatcaatgcaagcaggcgcaaacggattgctaaaggaagcgggacatccgtccaggaagtcaaccgtcttttaaagcaatttgaagaaatgaaaaaaatgatgaaacagatgacaaacatgacaaaaggcaagaaaaaagggtttaaactgcccttcatgtaaacctgttttcagatgataaaaacgttgttaagaaaaaacactttacaaacacttttatcattgttaatatactatcttgttgaaatattttcggaggtgctagtaaaatggcagtaaaaattcgtttaaaacgtatgggagctaaaaaatctcctttctatcgtattgttgtagcagattctcgttcaccgcgtgacggccgcttcatcgaaacagtcggaacttacaacccgcttgcaaaaccagcggaagtcaaaatcgacgaagagcttgcgcttaaatggcttcaaacaggagctaaaccgtctgacacggttcgcaacctgttctcaaaagaaggcattatggaaaaattccacaacgctaaacaaagcaaataatgagtgatctgcacttggaagagctgattgtatcactggtcaaaccgcttgtggatcacccggatgatgttcaggttttcaaagaggaaaatccagagcggattatgttccgcctgtctgtcaacagagaggataccggcaagatcatcggcaaaaaagggcgcactgcaagagcgatacgctctgtcgtatttgcggcaggcgcacagtcttctaagaaagttcaacttgagatcgcagactaaggggagagggtgaaaacctcccccttttttaacatgtaagaaaaatagaaacagatgaacgattccgatcgtcagcttatgccaggctgccggatttcagggaaaggaaaaatcacgggacagtaggtgatgatgccatgcaaattatccaacgtgttaccgtcatgcaggttttgactgaaaacagcaaaaaaaagctgctggcttcttttgaagaaagaaaggaaatccttgagcgcgaatgcaaccagctctattttcagctcaggaaacacgaaaaggaacaccacaatccggcggcgactgaatcatttaaaaaagaaattgaaaaacgacaggacaagattaaaatgatcgtttttcaaatcaatcaaatccacacactgccgcttggcagcgaagtaaaggaaaaagaaatcgacgctttaatggacattgaagtcggggataattggcatgatatgacggcgggaaaaacaatcgtgattaaagacgggatcgtcattgaaattcgtccgaggtgaagaaatgctgaaacaatggtttaatgtagggaaaattgttaatactcatggggtaaaaggcgaagtccgcgtcatttcaagaaccgattttcctgaggagcggtacaagcccggaaacgcgctctacttgtttctggaaggaaaagacgagcctgtccaggtgaccgtcagcgcccacaggcttcacaaacagttccaccttttgcagtttaaagaggttgaaacgctcaccgaagccgaaaaattaaagaatgccttgattaaagttcccgaagaccaattaagccagttggcggaagacgaatactactttcacgaaatcatcggctgcgatgttttctcggaagacggggatttaatcggcaaggtgaaagaaattttaacgccgggcgccaacgatgtctgggtcgtggccagaccgggaaagaaagacgcgctcatcccttatattgacgccgttgtcaaagagattaacgtagcggataaaacgatcaagattcatatcatggaaggattacttgacgaatgaaaatcgattttttaacgctttttccggaaatgtttgaaggcgtgctcggctcgtcgatcctgcaaaaagctcaggacaaggacgctgtccgttttcgcgtggtgaactttcgggcctattccgacaacaagcatcaaaccgttgacgattatccatacggcggcggagccggaatggtgctgaaaccgcagcccgtctttgacgcggtcgaaaagctgacggctgaagccggagggtctccgagaatcatcctcgtctgcccccagggtgaacgctatacccagcagaaggcggaagaactggcgcgggaagagcatttaatgttcatttgcggccattatgaagggtatgatgaacggatcagggagcacctgtctacagacgagatttcgatcggagatttcgttttgacagggggagagctgccggcgatgatgatcgcagacagcgttgtgcggcttttgccgggcgtgctcggcaaggaagaatcgcaccttgaagactctttcagcacagggcttcttgaacaccctcattacacgcggccggcagattataaaggcttgaaggtgccggacgttctgacatccgggaaccatgcgaagatcaaagaatggcggcggaaggagtctctcaggcgcacatttttaaggcgtcccgaccttctggaaaactatcctttgtcagaagaagagcgaaagtggatttctgaatggaaaaaccggtagattctattgcgcccgggaaaaaggtgtggtatgatactacttgtgacttgaacgggaacgctcgtttaagtttgaaaacgatgttccgctgtgccggttaactcgcgcaagagcatctgttggaaggagttgaagacgatgcaaaaattgattgaagaaatcacaaaagaacaattgcgcactgatttgcctgcgttccgtcctggtgatactttacgtgtacacgttaaagttgtcgagggtaaccgtgagcgtatccaggtttttgaaggtgtcgtgattaagcgtcgtggtggcggaatcagcgaaactttcacagttcgtaagatttcttacggtgtcggagttgagcgtacattcccattgcacacaccgaaaatcgcgaaaatcgaagttgtccgtcatggtaaagtacgccgtgcgaaactttattacttgcgcgaacttcgtggaaaagcggctcgtattaaagaaatcagacgataatgataacgaacgaaaagagcttgttaaccataacaagctctttttttgtcaaacaagtataaatgcatcgcaccattaaaagaatagcaataacagaaagtaggtggcagacaaatggtgatccaatggttccccgggcatatggccaaagcgaggcgggaagtaacggaaaaactcaagctgatcgacattgtatacgaactggtcgacgccagaattccgatgtcttcaagaaacccgatgatcgaagacattttaaagaacaagccgagaatcatgctgctcaacaaggcggataaagcggactcctccgtgacaaaggcttggaagcagcactttgaaaaagacggaattcctaccctcgccatcaactcggtcaacggacaggggctcaatcaaattcttcctgcatcaaaagagctgctgaaagaaaagtttgataaaatgaaagcaaaaggtgtaaagccgcgcgcgatcagagcattgatcgtcggtattccaaacgtcggcaaatcgaccttgatcaaccggcttgcgaaaaaaaacatcgccaaaacgggcgacagacccggagtaacgactgcacagcagtgggtgaaggtcggaaaagagctggagcttctcgatacaccggggattttatggccgaagtttgaggacgagcttgtcgggctgaggctcgcggcaacaggcgcaattaaagattcgattatcaacttgcaggatgtcgccgtctacggtttgcgctttttggaagagaattaccccgaacgcttaaaaaagcgctatgacctggaggagattcctgaagaaattgcagcgctttttgatgagatcggaaaaaaacgcggctgcctcatggccggaggcgagatcaattacgacaagacgacagaagtcatcatccgcgatatccgcaccgaaaagttcggcccgctttcttttgaaaagccggaggatatgtaaaaaggcgcgcttttaaaagagcgggcctttatttttgcagaagatgcgccgataagaacattaggggagaagagaaagtgaaaacattaaccgtcaaagaaattaaagaacatcttcaatcggtgagcgatgaaaaggacccttttatagagcagtgcaaaaatgatgagcgaaaaagcgttcaagcgctcgtcgacgcctggctgaagaaaaatgaaaggctttcggccatgcgggaagagtggcaggcgatgacgtcttttgaacggtcgctgagagcgcggggctatcaatatatcgccggaatcgacgaggcgggcagagggcctctcgcagggccggttgtcgccgccgctgtcatcctcaaagaagattgtgaaatattagggctgacagattcgaaaaaactgtcaaagcaaaaaagagaagactattattcatacataatggaagaagccgcagcagtcggcgtcgggatcgcggacgcccatgagatcgatgagctgaatatttatgaagcctccaaagcggcgatgctgaaagcggtccaagcgctggacgtcgcaccggattatcttctgatcgacgccatgtcgcttgcggtcgatacagagcagtcatcgattattaaaggggatgccaaaagcgcctcgatagcagcaggcgcatgcatcgcaaaggtgacgagggacaggctgatggatgaatacgctgaaaagtatcctctctacgggtttgaaaagcataaaggctacggaacgaaggagcatctgaatgccctggcgaaatacggcccgtcgccgatacaccgaagatcgttcgcccctgttaaagcacatgaataacgttccggaggaagaatgactttgatgatgctgaacgatgtacataacagcttaagaaaacaatttgaacaagcggattctctccagcggatcagcggaacggagacggatcagaaaaggctgatgctcggcaaagtgctccgctttatcagcgagcagttcgccgaaatacaaatcggcaatacgaaatggcaggggaagcttgaggcacccctgaaagcgggcgctcattactggttttcgtatgaaaagaagccggatgaagcgacaggccgccttcaggtcgttgaagcgtttgacaaaaacccgaagaccgtgcaggatgccgcctttaagctgttgaacgggctttctctgaagcggacgaaggaagccgtctttctggtcggagcgttgctgaaggagcagcagccgatcagggaaaacgatttaagagccgccatcaagtggcttgaaaatctgccgaagtccgatgcccaaaaaggcgccgatgccgtcatgttcgctcttaaacgcgaacttcccgtccaccccggcgtgctcgattcgattatggccgtcaaaagccccgttccgctcaatgagcagattgcgagaacgcttgatatgatcgcgaacgccgctcagccatccccaggcatggaaaagctgaaacaggcgcttttgccagttttacaagcggagactgaggtgcatgccgaaaggctgattcaaaagcttgcggaacacatcagatcgctggaaaaaggagaactgcaggccgttctgccattaaagccgcaggttcagtcagaaggcggaaaacctccgcaaaaagcagacgctggcggcgcatacggacaggaagcaaaagcagcccagcacaatccgcaaatcgcagcagctaaagacgtgttcgctaaattggcggcacaagccgaaacgaacgggacgcatattgcaagagaagcggcaggcgtcatcaaagcgcttgaatcgcgcggagctctcggacaagctccggccgttctggaaggattcacgccaaaagagacggaacttttgcagcatatcatgaaagaaacagcgcctgcattgacgaataaagccgatgtattatccgttctcctcaagatcaaagatgttttaggcgtcagagatgagctctcattgttgagagcgatggaaaacggcgccgttctcaaagagcagggcctgcaatctttaaagctcgtgctgaatgaaatgaggcatgcttccgatcttccggctcctgtaaaacaggaagcggaccaaatctttcaccgtttaaacggacagctgtttttgcagaatgatcagcctgcccagagccagctttttctgtcgtaccctctgttttcaaagaacggcgtccaggatttgaacgttttcttaaaagggcagaaaaaagacgacggaaaaatcgacccttcccagtgccgcctcatgttttaccttcagttggaagcccttgaagagacggtgatcgattgtttgatccagcaaaacgtcatgacggttacaattgaaacaaagttcgatttggagtctttgattgaaccgctggtcccggctttaaaggaaaacctgaaagagctgggctacagcttgtcaggcgtctcagcaaaaaaacgggaaaacatgaagctcgctccgtttttggagtcccgttttgaacaaattacagagagcgcagtggatgtgaaaatatgaaggaatctgttccattaagaagagctgttgcgcttcactacgatgaaatgaaggacaaggcgccgaaggtggttgccaaagggtcgggatacacggcggagaagatcattgaagaggcgcagaaagccggtgttccgattcaggaagatgcgacgcttgtcgaattgatgcgccacttggagcttgacgaccacattcctgaagcgctttacgagatcgtcgccgagatcttttcattcgtctatacgcttgatgaaaaaatgaaaaagagggaatgacttttgaaaaaaagccgtttcctctattaattttatatttttaataaaataaaagtgtgaatgtttagaaggattttacgatttctcatcgaaacctagacaatcgatctatgattatataaaatgaaagcgcagtctatttttatttttgctacataagttaggaggatgggaaaatgaatatccatgagtaccaagggaaagaagtactcagaaaatacggagtggctgttccggaaggtaaagtggcatttacagcagatgaagcggtcaaagcagcggaagcgctgtccagctcggtttatgtcgtgaaagctcaaattcacgccggcggacgcggtaaagctggcggggttaaaattgcaaaatcaaaagaagaagtcaaagcctatgcggaagaattgttgggaaagacgcttgtcactcaccagacgggtcccgacggccaacaaataaaacgcttacttattgaagaaggctgcgatatcaaaaaagaatactatgtcggcctagttctcgacagggcgacttcacgcatcgtgctgatggcctctgaagaaggcggcacggaaattgaagaagtcgctgaaaaaacaccggaaaaaatcgtcaaagaagtgatcgatccggctgtcggactgcagagctaccaggcgagaaaaatcgccttcgccatcaatattccgaaagagcttgtcggccaggccgttaagtttatgatggggctgtacaaggcgtttactgaaaaagactgttccattgctgaaatcaatccgctcgtcgtcacaggggacggaaaagtcatggcccttgacgccaagctgaactttgacagcaatgcgctatacagacaaaaagacatcttggagtacagagatctcgatgaagaagatccgaaggaaatcgaagcatccaagtatgatttaagctatatttcgctcgatggaaacatcggctgcatggtcaacggagcggggcttgcgatgtcgaccatggacattatcaagcactacggaggggaaccggccaacttccttgacgttggaggcggcgcgacagccgaaaaggtaacggaagcgttcaagatcattttgtctgatcaaaacgtcaaagggatctttgtcaatattttcggcggcatcatgaaatgcgacgtcattgcagaaggcgttgttgaagcgacaaaacaagtcggtctgacattgccgcttgtcgttcgccttgaaggcaccaatgtcgatctcggcaagaagatcctcgatgattcaggactcaatattacgtctgcggaatcaatggctgacggcgcgcagaaaatcgtatccttagtgaagtaagaaaggcaggggaccaaaatgagtgtatttattaataaagacacaaaagtcattgttcaggggataacgggttcaaccgctttgtttcacacaaagcagatgcttgaatacggaacgaaaattgtcggcggagtcacaccgggcaaaggcggaacagaggtcgaaggggtgcctgtgttcaatacggtcgaagaggctgtaaagcagaccggggcaaatgcgtctgtcatttacgttcctgcggcttttgcggccgatgcgattatggaagcgacagatgctgagcttgatcttgtcatctgcattactgagcatattccggtgcttgatatggtaaaagtcaaaaggtatatggaaggcaagaaaacgagactcatcggtccgaactgcccgggagtcattacgcctgaggaatgcaaaatcgggatcatgcccggatatatccataaaaaaggccatgtcggcgttgtgtcgcgttcaggaacccttacatatgaagcggttcatcagctttccgaagcaggagtcggccagtcgacagcagtgggcatcggcggagaccccgtcaacggcacaaacttcatcgatgtgctgaaggcttttaatgaagatcctgatacacatgcggtgatcatgatcggcgaaatcggcggaacagctgaagaggaagcggctgaatgggtgaaagccaacatgaccaaacctgtcgtcggtttcatcggaggaaagacagcgcctccgggcaagcgcatggggcatgcgggcgccatcatttccggaggaaaaggcacggcggacgaaaagatcaaaacgatgaatgcctgcggaatcgaagtggctgaaacgccttctgtcatgggagaaacattgattaaagtgctgaaggaaaaaggtctttacgaaacgtgtaaaacacactgatgattaaaaagagcgggaatagtccgattggtctattcctgctttttcataactggttatatcgtttagtactttcagattgttttgttttaaaaatttttggaggtttttgaatgaacgacagcagcgagcttttgatattgctccgccttcgcggcacactctccccttctctgctgaccaagtggtggaagcaggacccttccttgtctcttacgggcgaaaaaaaccatcttttaacgaagctttcattaaaaagatcagacttgtgctccatacgaaaactggcggaacaagaactgtctaatgttaaacggctcatccgttcttacgaggcggccggcgtccgcatgaccgccatatcttcccctgattatccagccagcctgaaaaccattcatgacccgcctcccgtcctttttttaaaaggaaacaaaaaacttctccatgaacaaagactgatcggaatcgtcggaactcgctgcccgtcattatacggaaaaagagctgcggtccagcttgtcagggagctttgcaaaaacagctggacgatcgtcagcggtcttgcaaaaggaattgacggtctcgcccatcaggagagcatccgttcaaagggaaggacaatcggcgttatcgcgggcggattcaacagcatatatccccgtgaacatcgccagctcgccggacaaatggccgaaagccacctgctggtatcagagcaccctcctcacattaaaccgcaaaaatggcattttcccatgcgaaatcggctgatcagcggattaacggaaggaatcgttgtcgtccaaggcaaggaaaagagcggatcgctcattacagcataccaagcccttgagcaggggcgggaggtgttcgccgtgccgggtccgatctttgatgccaactctttcggtccttcaaggctgatccaggaaggggcgaaactcgtattaactattgaagacattttgaacgaacttccgccttcaaacgctcaatatacagagcctgtttagaattatcgtttgacaaaccgtattgtaatatttaataatagtgaggatttcaagtttaaacgctttaatcggcgttcaacatatagaaggattaaatcagacacttttcgtaaaaataatgactatataaacgacgattatgctgaatacaataaaaaggctaaattgaaaagagagagaacacctcttgagggggataatgttatgtccgaatacttagtcatcgtggaatcgcctgcaaaggcaaaaacgattgagcgatacttaggaaaaaaatataaagtaaaagcctcgatggggcacgtcagagatttgccgaaaagccagatgggcgttgacatcgagcagaactttgaaccaaaatacattacgatccgcgggaaaggccccgtgttgaaagaattaaaaacggccgccaaaaaggcaaaaaaagtttatctcgcagccgaccccgacagggaaggggaagcgattgcgtggcatttggcgcacagccttgatttggacctgaattccgactgccgcgtcgtatttaatgaaattacaaaagatgcgatcaaagaatcatttaagcatccgcgcatgatcaatatggatcttgtcgacgcccagcaggcgagaagaattctggaccgccttgtagggtacaaaatcagtccgatattatggaaaaaagtaaaaaaaggcttgagtgcgggacgtgtccaatctgttgcgctccgccttatcattgaccgggagaaagaaatcaacgattttataccggaagaatattggacaattgaagggtcttttctcaaaggtaaagaaacgtttgaagcgagcttcttcggaatcaacggggaaaagcaccagctgaaaagcgaagatgatgtgaagcaaatcctatcccggatcaaagggaacaaatttgaggtcaaaaaggtaacgaaaaaagaacggaagcgaaatcctgcgctcccatttacgacgtcgacgcttcagcaggaagcggcgcgcaaattgaatttccgggcaaagaaaacgatgatgatcgcccagcagctttatgaaggaatcgatctcggcaaagaaggaacggtcgggttaatcacttatatgagaacggattcaacccgtatctcgaatactgctcaagaagaagcggcatcattcatcggcgaacagtacggaaaagaatttttgggtagcaagcgaaagccggccaaaaagaatgaaaacgcccaggatgcccacgaagcgatcaggccgacctcggtgctcagaaagccttccgatctgaaggcggtattgggaagagaccagcttcggctatacaagctgatctgggagcgctttgtcgcaagccaaatggctccggcgacactggatacgatgagcgtcgaccttgaaaacaacgggttgacatttcgggcaaacggcagtaaagtcaagttttcaggcttcatgaaagtgtacgttgaaggcaaagacgatcagatggaagagaagaataagatgcttccggatctcgctgaaggcgataccgtgctttcaaaagacatcgagcccgaacagcacttcacacagccgcctccgcgctatacggaagcaaggctggtcaaaacgcttgaagaactgggaatcggacgtccatccacatacgcgccgacgcttgacacgatccaaaagcgcgggtatgtcgcccttgataataaacgctttattccgactgagctcggtgaaattgtgcttgacttgatcatggagtttttccctgagattattaacgttgagttcaccgccaaaatggaaaaagagcttgatgacgttgaagacggaaacattcaatgggtgcagatcatcgattccttttacaaggactttgaaaagcgtgttgaaaaagcggaagccgagatgcaggaagtggagatcgaaccggagtatgcaggtgttgactgtgaagcgtgcggacatccgatggtctataaaatgggccggtacggcaaatttatggcctgctccaattttccggactgccgcaacaccaagccgatcgtaaaagagatcggcgtcaaatgcccatcatgcaaaaccggcaacatcgtcgagcgcaaatcgaaaaaacgccgcattttttacggctgtgaccgctatcctgaatgtgaattcgtatcatgggataaaccgcttgaacggaaatgtccgaaatgcgaggacatgcttgtggagaaaaagctcaaaaaaggcgttcaagtgcagtgcgttaattgcgattataaggaagaacaacaaaagtagcggtgagcagggctttgctcaccttctttgttgtgttaaaagaataagtcaattcataaattaggagatgtgaatatgaatcaaacagtaaatgtcatcggtgcaggacttgcaggaagcgaagcggcatggcagcttgctaagcgcggtatcaatgtccgtttatacgaaatgaggccagtcaagcaaacgccggcgcaccatacagataaatttgccgaacttgtctgcagcaactcgcttcgggcgaattcattaacgaatgctgtcggtgtattaaaggaagaaatgcgggttcttgactcggccatcatcgctgctgctgacgaatgttctgttcctgccggcggtgcgcttgccgtagacaggcatgaatttgccgcaaacgttaccgaaaaagtaaagaatcatccgaatgtgaccgtgcttcatgaagaagtcacggaaataccggaaggaccgacaatcattgcgacaggaccgctgacatcagaagcgctttccgcaaagctccgggagctgacaggcgaggactatctatacttttatgacgcggctgcgccgattgttgaaaaagacagccttgacatggataaagtctatttgaaatcccgctatgacaaaggggaggcagcgtatttgaactgtccgatgacagaagaagagtttgacaggttttatgacgcccttgtgtctgcggaaaccgttccattgaaagaatttgaaaaggaaatcttctttgaaggctgtatgccgattgaagtcatggcgaagcgcggcaaaaaaaccatgctgttcggcccgatgaagcctgtcggacttgaagacccaaaaacaggaaagcgtccgtacgccgttgtgcagctgcgccaagatgatgcagccggcacgctttacaatatcgtcggttttcaaacccacctcaaatggggcgaccaaaaagaagtgctccgcctcattccgggactggaacaggcagaaatcgtccgctacggcgtgatgcacagaaatacgttcatcaactcgccgagtctgttaaaagcgacctaccagtttaaaaagcgggacgatctgttttttgccggtcaaatgacaggtgttgaagggtatgttgaatcagcggcttcaggtcttgttgccggtataaatgcggctcggctcatccagggaaaagaacctgtcactttttcaaatgaaacagcgatcggcagcatggcccattacattacggaaacaaacaagaaaaacttccagccgatgaatgcaaacttcggcctgttcaaagaattgggtgttaaaattaaaaacaagcaggaacgaaatgaacagtatgcttcgcgcgcattggagacaattcgaaatatttcgaaaacgctatagttattcattgccagatgaacttgttatgtgataacatttaaaagcccttttcgaagaggtgtaatgatggcaaatgttaagaattttttaactttattcattgaatatttacaaatagaaaagaattattcaaaatatacaattgtgggttacatttcttccattgaagactttgaacgctttttacacgttcagggcataaagggttttgaagacgtgacttatccggatgtgagaattttcttgacggaagcgcatgaaaaagggctcactcgcaggacgatcagcaagaaaatttcggctctgcgtagcttctataaatttttattaagggaaaagctggtaaaagaaaacccgtttctgcttgtcagtctcccgaaacaggataagcggattccgaagtttttatatgaaaaggaacttgaagaactgtttgaggtttcggatttgagtacaccgctcggccaaagaaatcaggcgctcctggaatttctctacgcgacaggcatgcgggtaagcgaactttgcagcctgaaggaatctgatttggatctgtttttagatacggttttggtccacgggaaaggcaggaagcaaaggtatattccatttggttcattcgcccgggaggctttggatctgtatttgcaaaatggaagacgcatccttctgttaaaagcgaaagagccctgcccttttatttttttgaatcaaaggggcgggcccttaaccccgaggggggttcgttacattttgggagaactggtcaagaagacttcgggtacattacatatacatccgcatatgctccgccatacatttgccacccatttgttaaatgagggtgcggatctgaggagcgttcaggaactgcttgggcattcaaatctttcttcaacccaggtgtatacgcatgtatctaaagatatgctcagaaagacatatatgtctcatcaccctcgggcacataaagggaaataaaggaggttcttttatgtcatcttttcacgcaacgacgatatttgccgtccagcacaacggaaaaagcgcgatggcgggagacggccaggttacgttcggtcaggctgtcgtcatgaagcataccgcaagaaaggtaagaaaactcttcaacggaaaggtcattgccggttttgccggttctgttgcagacgctttcacgctctttgaaatgtttgaagcgaagcttgaagaatacaacggcaatttgcagcgggcggcagtcgagcttgcaaaagagtggcgaagcgataaagtcctcagaaagcttgaggcgatgctgatcgtcatgaatgccgacagcatgctgctcgtttccggaacaggcgaagtgattgaaccggacgacggcattttggcgatcggctcaggtggaaactacgcgcttgcagccggaagggcgctgaaacgtcatgccggcagccagcttgacgcgaaagcgattgcgagggcttcacttgaaaccgcgggcgaaatctgtgtgtatacgaacgatcagatcattgtagaagaacttgaatagaaaggatatgaggcatatggaaaaaaagccgctgactcctaggcagatcgtcgaaaggcttgatcaatacatcgtcggccagctcgatgcgaaaaaagcggtcgccgtggcattgaggaaccgctacagaagaagtcttcttgatgaaaaactgcgcgaagaaatcgttccgaaaaacatattgatgatgggcccgacaggtgtgggaaaaaccgagattgcaagacgaatcgcgaaactcgtcggcgctccgttcgtcaaaatcgaagcgacgaagttcacggaagtcggttatgtgggcagagatgtggagtcgatggtcagggatcttgtggaaacgtcagtccgcctcgtcaaagaggaaaaaatgaacgaagtgaaaggcatcgctgaagaaaacgcaaataaacgcctcgtccgcctgcttgtaccgggaagaaaaaaacagacaggtgcgaaaaatccttttgaaatgctgtttggcggaaatcaggatcaagaaactggtgaagcggaaaagcaagaagacgcggatatcgaaaacaaccgaaaacggattgcgcatcagcttgctctcggcgaacttgaagaccattatgtcaccgttgaggtggaggagcagcagccgtccatgtttgatatgctccaaggctcgggtatggaacagatgggcatgaacatgcaggatgcgctcagcagcctgatgccgaaaaagaaaaagcgccgcaagcttacggtcagggaagcgcgaaaagtgctgacgaatgaagaagcggcaaagctcatcgatatggacgaagctgcccaggaagctgtccagagagccgaacagtcgggaatcatctttatcgatgagatcgataaaatcgccaaaaagagcggtgcttcttcatcggcagacgtctcaagagaaggcgtgcagcgcgatattcttccgattgttgaaggatctaccgtcatgacaaagtacggtgcggtcaaaacggatcacgttctgttcattgctgcaggtgcattccacatggcgaagccttcagatctaattcctgagctgcaggggcgctttccaatacgcgttgagcttcaaaagctgagcatcgatgactttgtgaaaattttaactgagcctgacaacgctcttcttaagcagtataaggctttattgaagacggaaggtatatctcttgaattttctgacgatgctattcgtaagattgcagaagtggcttatcatgtgaaccaggacacagacaatattggggcgagaaggcttcacaccattttggaacgtcttttggaagaactgtcattcgaggctccggatgtgacgatggaagaagtggtcatcacgcctcaatatgttgaagaaaagctcggttcgatcgctaagaataaggatttaagccagtttattttataaacaattaaataagagtaatttaggaggatcaatttattatggctttattacaaaaaacaagaaagattaatgcaatgctgcaaaatgcggcagggaagccggttaattttaaagaaatggccgaaacgcttcgcgatgtgattgattcgaacattttcgtcgtcagccgcagaggaaagcttctcggtttctcgatcaaccagcagatcgaaaatgaccggatgaaaaaaatgcttgaagagcgccagtttcctgaagattatacaaaaagcctgttcaacattccggaaacgtcatctaaccttgacatcaacagcgaatacacagctttccctgtggaaaaccgcgatttgttccaagcgggtctgaccacggtcgttccgatcatcggaggaggcgaaagactgggcaccttgattctgtcccgccttcaggagaaattcgaggatgacgatctgatccttgccgaatatggcgccactgtcgtaggaatggaaattctcagagagaaagcggaagagatcgaagaggaagcgcgcagcaaagcggtcgttcaaatggcgatcagttcactatcttacagcgagcttgaagcaattgaacatatttttgaggagcttgacggaaatgaaggcctgcttgtcgctagtaaaattgcagaccgcgtcggcatcacccgctcggtcattgtcaacgcgctccgtaaacttgaaagcgccggtgtcattgaatcaaggtcactagggatgaaaggcacatacatcaaagtgctgaacaacaaatttttgatggagttagaaaaactaaagtctcattaaaaggcgaaagccgcagaacatgccgttctgcggctttttttatttcatgttttaaactatattatcgtaattttttcatatcaaaaaacaactaaaacgcggtgcaaaatcaatgcgttacttgaataaaagatatactaacataattttttgaaactttaatgaacgtaacattacatagttcttataatctaggtcaaaatacctattcataaaatagatatttcttacgatttttttttgcttccagatcatagactttaagcctattattccttacaataggcttatggtttttacaattctcgacaagattttaagacagatggaaaaagattggaggtatttggacggtggatatattttcaggaacgatacatagactagagggagccttgaatcaagcgaacattaagcaaaaagtcataacgaacaatctggccaatgtagatacaccgaactacaaggcgaaaaaagtatccttcaaaaatgtgctgaatgaggagtcctcccggattaatgccataaaaacagactatagacacattgactttaaagggaatgagccaaattattcagttgtgtcgagaaagaatacaacttatcaagaaaacgggaacaatgtggacgttgatcaggaaatgagtgaaatggcgaaaaatcaaatccagtatcaagcgctggttgaaagaataagcggaaaattcaactcgctaagaaccgcgattacaggaggtaaataatgggggtattcaatagcatcaacatttcagcttcagcgttgactgcacagagagtcagaatggataccgtttcttccaacctggcaaacatggatacgacgagagcgaagctggttgacggacagtggcagccgtatagaagaaagcttgtatcgacggctccgaaaggcgaatccttttcatccgttctccaatcatcgatgaatgcatcggcgagagtcggcgaaggggtgaaggtgaccaagataagcgaagacaaaacaccgtttaagctcgtttatgatccgacccatcccgacgcaaacgaagacggatacgtgcagatgccgaatgtcgatccgctaaaagagatggtcgatttaatgagcagcacaaggtcatatgaagccaatgtcacagcaatgaacgcgacaaaaggaatgctgatgaaagcattagaaatcggaaagtagggtgatgacacgaatggttaatggaatctctccgtttggagttcaatccgtgcaggcgggaacgaatgcaacaaatcagatcaagaacaagcaggacggttcagagaaccaagtcagcttttccaacgtgctgaaagattctatcaatgctttgaatcaatctcaaaatgaatctgataaactgacaaacgcgcttgctctcggtcaggatgtcaaccttgatgaagtgatgattgcagcccagaaggcaaacattacattgacggctgcgacggaattccgcaacaaagcggttgaagcttatcaggaaatcatgagaatgcaaatgtaagaaaggagtctgaaagcgaagagaattagtgtaactaccgggggagtaagatgaatcgtaatttattgcaaattaaaacgaaaataactgatttttggaaaaacagatcaaagctgcagaagattctgctgatcggcattgtcgctctggcagtcatcctgtcaatcatcattggaattgttgcttcgtcaaataaaatggtgccgctctataaagatttgtcagctgaagaaaccggccaaatcaaacaggtgctcgatgaaaaaggtattccatctgaagttgcgactgacggttcagtcatcaaagttccggaagaaaaagtcgatgaactgaaagtcgatcttgccgcagagggccttccgaaaagcgggagcatcgattattcattctttggcgaaaatgccggtttcggcatgacggacaacgaatttgacgttttgaaagtgaaagccacgcaaaccgagctatccaacctcatcaaaggaatagacgggattaaagattcgaaggttatgattaacctgccgaaggaatccgtctttgtcggagaggaaaagccggaagcatccgcttcgattgttcttcaggtgaagcccggccacacgcttgatcaaaatgaaatcaacggcctttatcatctcgtatcgaaaagcgtgccgaaccttgacccgaaaaacatcgtgatcatggatcaaaactccacatattacgatcaaacaggcaaagagtccggttcttacgccgacagctattcttcccaaagggaagtcaaggcccagatcgaaaaggacctgcaaagacaaatccaaaccatgctcggcacgatgatgggacaggataaagtggttgtatccgtcacatctgacatcgatttcacaaaagaaaacaggacggaagacctggttgaacctgtcgacaaagaaaatatggaaggaatcacggtcagcgcagagcgcgtcagtgaaacatattccggacagggagcacaagcgggaggcgtcaacggaacaggtgaaaacgatgtaacgaactatgctgaaacagaaggcggaacaggcaacggagactatgagaaaagcgaagaacgaatcaacaatgaagtcaacagaatccataaagaaatcgctgagagcccgtacaaaatcagagatctgggcgtccaggtcatggttgaaccgcctgatgcaaacaacccgcagtcactgcctgctgaaagggaggacgatattaaaaaaatcctctcaaccattgtgaaaacatcgattgacaagaactatgaagaagagcctctgacagatgaggatgttgaaaataaaatcgttgtttctgtccaatcgttcgacggcaagcagacaatcgatgaaggaacggaaacaggcggcataccgatgtgggcttacatcgcaggcggagcagcgcttgttgctgtaatcggcctcatcatctggcttgtcagaagacgtaaaaatagagatgacgaatacgaggaagaatggtatgaaacgcctcaggagccgattcgggttgctgatgtgaacaatgaaaaagagacagaagaaactgtcagacgaaaacagcttgaaaaaatggcgaaagacaagcctgaagaattcgccaaattactgcgcagctggctgaccgaggattaggaggagtattgaaatggcaaaaatgaaacaagacaggcttacaggcaaacaaaaagcggccattctcatgatatccttagggcttgatgtgtcagcttccgtttacaagcatttaacagatgaagagatcgaaaggctgacgcttgaaatatcaaatgtcagagctgtatcacctgagaaaaaagatgagattattcaggaatttcatgaaacggctattgctcaagaatatatttctcaaggcggcattcattacgccaagcaggtgcttgacaaagcgctcggcgaagacaaagccgccagcattatcaacaggctgacatcgtctcttcaagtcagaccgttcgattttgccagaaaagcggatcccgagcagattctgaactttatccagcatgagcacccgcagacgatcgcattgattctgtcttatctcgatcccgtgcaatcgggtcagatattgtcagagctgaatcaggatgtgcaggcagaggttgcaagaaggatcgctgttatggacaggacgtcgccggaaatcatcaatgaagtcgaacagattctggagcaaaagctatcgtccacattcactcaggactacacgcagaccggcggtatcgaagccgtagtcgaagtgttgaacggagttgacagaggtacggagaaaacgatccttgacgcccttgaaattcaggatcctgagcttgccgacgagattaaaaagcggatgttcgtctttgaagatatcgttacgcttgataaccgcgctattcaaagggttatccgcgatgtggaaaacgacgatctgcttctttctctcaaagtggccagcgaagaggtcaaagacatcgtcttcagcaacatgtcgcagcgtatggctgaaacatttaaagaggaaatggaattcatgggccctgtgcgtctgcgtgacgtagaagaagctcaatcgagaatcgtaagcgtcatccgaagacttgaagaagcaggtgagatcgtaatcgccagaggcggaggagatgatatcattgtctaacattattaaacagcgattatcatcaataccgcaaaaagaaaggcggacgatttcattaaaggaagtcaaacttcctgagacagaaaccgaacttgataccggacaggatccggaatacctcctcgaccatgccagacaagaagccggaaaaatatacgaaaaagcgagcgctgaactcgaacaggtcagacggcaaatcgaagaggaacggtcaagctgggaaacagaacgcgaagcgctgatagaccaggcgaaacaagaaggctttcaagctggatttgaagagggaaaggccgaggcccgaagcgcttatcaagcgtatttggatgaagccaatgccatcgtccgggcggctagacgtgactatgaagaaaaaatcgaacaatcatccgaagaaattgtcgaacttgccgtgtcactggctaaaaaagtttggaatcaaaaggctgacgacaaagaagcttttacagccctcgtaaaacaggtgctgtcggaaatgaaggaattcgatgacattgccatctatgtagatccggagtactacaccgaggttcaaagccacaaaaacgaacttgagcagctcctccaatacggcgcccatatcgcgatatacgccgatgaaaaagcgccgaaaggaacgtgctatgttgaaacggctttcggaagaatcgatgcaggcatcgacactcaattgcagcagctgaaacaaaaactgctcagcctgcttgaaacggcaggtgttgtccggtgatgctcaagcagctgcttgaatgtatagaaaccgcagattcctacaaacgatacggaaaagtcaaacaggcggtcggcctgatgattgaatccaaaggacctgaatgttcaatcggcgatgtctgcaaaatctatacaaaaggtgacgggccaaaggctattaaagctgaagttgtcggcttcaaagaccaaaatattcttctgatgccatatttggaagcggccaatattgcccccggcagcattgtcgaagcgacgggcgaatcgcttagggtcaaagtcggctccgggttgatcggacaagttgtcgatgcattcggcaatccgctcgacggcagcgtgcttccgaaaggtctggctcaagtatcgacagaccaggcgccgcctaatccgatgaaaaggccgccgatcagagaaaaaatggcggtcggcgtcagatcgatcgacagtctgctgaccgtcggaaaaggacagcgtgtcgggatattcgccggaagcggcgtcggaaaaagcacgcttatgggaatgattgcgagagagacggccgcagacttgaatgtcatcgctcttgtcggagagcggggccgggaagtcagggagttcatagagaaagatctcggcgaagaagggctgaagcgaacgatcgttgtagtggctacatctgaccagccggcgctgatgcgtctgaaagcggcctatacagcaacagcgattgccgagtacttccgcgacaaaggacaaaacgtcatgttcatgatggactcggtgacaagggtcgccatggcccagagggaaatcggcctggcgacgggcgaaccgccgacgacaaaaggttatacaccctcagtgttcgctattttacctaagctcttagaacgaacaggaacgacggaaagcgggtcaataactgctttctatacggttcttgtcgacggcgatgatatgaatgaaccgatcgccgatactgtaaggggaatcttggacggccatatcgttcttgaccgagcccttgcgaataaaggccagtttccggcagtcaacattttaaaaagcatcagcagggtgatgtcgaacatcgccgagaaagaccatatcagagcagcgaaccggttcagggaaatgctgtcaacctatcaaaactcagaggatctgatcaacataggagcctataaaaaagggtcttccagagaaattgatgaggccatacaattccaccctaagctgatcagcttcctcaagcaggaagtggatgaagcggcatcgctggaagagagcatttccttattaaagagtcttacaggaagagaggattaagaatggcttattcatttaaatttcaaaagctcctcgagcttaaagaaaatgaaaaagaccaatcatttgctgaatatcagcactcagtttccgaattcgaaaaggtcgcggaaaagctgtatgaaagcatgagccaaaaagaaacgctggaaaaaaacaaggaaatcaagatgcagacggggatgagcgttcaggaaatgcggcattatcagcaatttgtcacaaatcttgaaacgacaatctaccattatcaaaagctcgtcatgatgaagagaaatgaaatgaatgaaaaacagcacgatttgacggagaaaaatatcgagctgaaaaaatttgaaaaaatgaaagaaaagcagtttgaaatgtattcgctgcaaaacaaagcaaatgagttaaaggaaatggacgatatctccattgcccagtacataactcaaggaagctaggggtagaaaaacgatgaccgaagaaaaaaaagccggtaaatttcagacatttttgtttgtcatcgtcattccgctgatctttttaatcgttgtagcgttcgtcggcatgtggcttttgggcgtcaattttcaggatgcagcctcaaaaattcccgtcgtaaaagagcttgtgaaaaacggcgaggatcaggacatagatcacgcaactaaacagcaggagaacaaagcagaaaagctccaaaagacgatcgatgaacaaaaaagcgaaatcgaaacgctgacgagtgacttaaaaacgagtgatcaagagattaaaaggctgaaacaaaaaatcagctcgctcgaaaaaacggaaaaagatgaaaaagagcaggataaaaagaacgccgaaggtcaaggagacggaaaagtcgtcaaaatttatgaaagcatgcaaagcaataaagctgcaaaaattttaagcgaattaaaagaggaagaggcaatcaatattttagattctttaagcaaaaagaaagtgactgagatcctctcaaaaatgtctcctgataaagcggctgtattcacagaaaagcttgtgaaaaacgaggcgaaaaacgaagcgaaaaaagaagggggggaatagcttgaggctttttgacgcaatctcctttgatgccaaacctgcggtggacactgcacctgcaaaaacgagcaagacgccgttgggcgcgctctttcagaatgtgctccagaaggaaaacagctcactttccccttttcaaaagggagaagagccttctcaggatacgccgttggaagggcttttgcatgaactgaagcaatggctttcaaataaggaagacagctctttcaatgaagactggctgaattcccttcagcagcttgaagagctgaatgcatctccggatgaactggcattggcagaacagctgttacaacaaataaaagagctgcttgaaaaagccgccctgcctgaacaatcaggcaaaacggctgatgctaaagctttgcctgccgacgaaagcgggacagaagagccgaaaaagcccgacctgcaaattctcggccagattcagcagctgctagctgcgattgtaaatgaaaatcaaccgtcactcaaaacttcgcaaatcgcagaattattgaaacaggcgccggaatttctcgccgctcttcaaacaaaggcgggagcagaagggctgattgatgagcttaaacgtcaatttttcacgaaagatccgagccaatcgcagcttttgtccatgtcaaacaccgagctgaaaagcttgaaaagcttaatggagcagatgatgaacgcaaacgctgaaccggatcaaaaagagtggaaaatggccgaaagcgaactcaaggcaatgctcatgagcaagaaaaccgatgtttctctttctgagaagccgttgtcctttgttttgaacagaagagaaattcaaactgaaggaaagcaaggccaaaaggaacagccgattcaatcctctgtactggccaatcatcggacaggcacagcgctgatccagggtctccagccttcggcggcagaggaagcttccgctcagccgaaaagcttttcagaacaaattctcagctcatggaaacagatgaagtatacgccgttcggcaggtcgacaggcagtttcacgatccgcctgaatcctgaaaatcttggctttatcacgatcaagctcgtcaaacagcacgggatgttttcaagcaaaatcatcgcatcgacccagtcggctaaagagctgctcgaacacaatctcgcgcatcttaaacaggcgctgcccaacatgtctgtgcaaattgaccgcttcggtgttccgcttcaaaacagcgatcagactttcggacagctggcggacgatgagaaaaaccagcatcagccgaagcaagatcagcaaagtaagcaggaaaatgaggattttcaggagtttctggatgagcttatcgagactcgatcacaggacagcgaggaggagatctaatgtctgatacttcaattgataccagaaccgccttaggaacaacaaacacgaaatcgacgacatccgattttttatccgaggcaaaaaaagccgagaaagcagggagcggctccaatcttgggaaggatgaatttttgaaactgctgatgaaacaactgcagtaccaagatcccttaaatccgatggaagaccgcgaattcattgcgcaaatggcgaccttttcaagcctagagcagctaacgaatctgaacacaacgatgtcgacgttcgtcggacttcaggacccgatgacgatgtatgtcagctggatcggaaaagaagtcacctatgaaggcgaagacagcgaagaaaaaacggcgctcgtcaaatcagttaaaagctcagacggacagtatctgcttgtccttgacgatggaaccgaagtcaatccgtggaatgtgacggcggtaagccattctgataaataaaaacagacaattcagggaggaataattatgttacgttcactatactcaggaatcagcggcatgaaaaactttcagacaaagcttgatgtcgtcgccaacaacatctcgaatatcaatacggcaggctataagaaaagccgggttacgtttaaagatattgtcagccagcagctttccggcgcgtcgtcgtctactgcaaaccgcggctctgtaaacggccagcaggtcggactcggtgcaacgatcggatcgatcgatatcattcacacaaacgcagcgccttcgacaacaggccgccagcttgacatgaccattacaggagacggctacttccgcgtcggatcaggagatgaagtgtactacacaagatcaggaaacttctaccgatctgatgaaggtgacctcgtcactgttgacgggctgttcgtcttaacggccaataatggaagaatcaacattccgcaagacgcgcaaagcttcagcatcgctcctgacggaaccgtttcttatgtcgatcaaaacaacgagaaccagaccgccggccagatctcgcttgcgacattcagcaacacatccggattatcaaaagctggagacaacctttaccgcgaaacattgagttcgggagatccgcaagtcgttgtacctggggaaggcggctcaggaaaaattcaaacgagtgcgcttgaaatgtcgaacgtcgacctttcagaagaattttccgaaatgattatcgcgcagcgcggcttccagtccaatgcgaaaatcattacaacctctgatgaaattcttcaggaactcgtcaatctgaagcgataggagggaaggaggcgccctcgtgaaggcgcctcttgataacacatgatcaaagttacgcgattaaacggacagccctttattctgaatgcactattcattgagcaaattgaatgttttccggatacgacaattacgctgtccaacggaaaaaagtttgttgtcaaagaagatgaagatacagttgtggatacaatcgtgtcattctatcaaaaaatccaaatactttcttgtgaccaaagaattgaggaatctgaatgaataaaaaacttctaggaattatgatgacgattattttggcaattgctgtgttgggaaccgctgcgttctttgtcatcaagggaagcgcaagtgaaaaagatcaaaacgcagaaccttcgatcgatgaagtggtcgaatcttcagttgaagtcgccgaaatcacgacaaacttgaaatcagacaatgtagtccgtttgtcaatcaagcttgaaaccgattcgaaagaggcgaaagaagagcttgaaaagcgggatttccaaattaaagattcagtcatctcccttttggcgaacacgaacgcagatgagcttgaaggacaaaaaggaaaagaaaaatttaaagaacagctgaaagaaaagctgaacacgaactacatgaaagagggaaaagtgaaaactgtgtacattacctcctttaatctgcagtaggaacatagatgacagaaccatggaggtgaaaacagatggcaggagaagtgctctcccaaaatgaaatcgatgcactgctttcagcgatatcgaccggtgaaatggacgccgacgagctgaaaaaagaagagtccgttaaaaaagtaaaagtctatgactttaaacgggcgctccgcttttcaaaggatcaaatccgcagcttgaccaggattcacgataactttgcaaggctgctaacgacttatttctcagctcagttgagaacctatatccaaatctcggtcagctcggttgatcaggttccgtatgaggaattcatcagatcgattccgaatatgacgatcctcaatctgtttgaggttcgccctcttgaaggaagaatcatgatggagatcaacccgaccatcgcctatacgatgatggaccgggtgatgggcgggatcggctcgagccacaacaaaattgacagcatgacggagattgagacgaaaatcatgtccaatttattcgaaagctgtctcacgaattacaaagatgcgtgggaatccatcacggaaatcgagccggaaatgtccgattttgaagtgaatccgcagtttgtgcaaatggtatcgccgaatgagacggtcgttgtcatttcgctgaacacgcaaataggagacatcagcggggttatcaacctgtgcatcccgcacgtcgtcctggaaccgatcattcctaagctttccgttcactactggatgcaatcagacagaattgaaccaaaaccggaggaaacaaagtcgatagaaaagcggattttgacggcgcaaattccaattgtcgcagaactcggatcatcggaattaaccattgaagagtttttaaatttagaaattggagattgtatcactttggacaaatcagtagcagaacctcttactgttttggtcggagataaaccgaaatttctagcacaagccggccgaatgaatcgaaagactgcgattcaaattctagatcacgacataagaggtgaagaatatggagaataacaataggttatcacaggatgaaattgatgcgctgcttaaaggcggcgatgatacggctcaagagcagccagaatcagggttgtccctgatggaacaggatacgatcggggaaatcggaaacatttcctttgggagctctgcaacagctttgtccactttattgaatcaaaaagtcgaaattacaacgccgactgtttcggtgattgaaaaaagccatttaaatgatgagttcccgcacccgtatgtttcaatcggtgtgagctatacagaaggtttttcaggaaacaatcttctcgtcatcaagcaggaagatgccgcgatcattgctgacttgatgatggggggagacgggacgaacgcagatccgtcgcttggcgaaattcatctaagcgccgttcaggaagcgatgaaccaaatgatgggttccgctgcgacatcgatgtccaccgtcttcagcaagaagatcgatatttctccgccggaagttgacctccttgatgtgaaagaaggggaagggacagagcaaattccgaaagaggacccgctcgtcaaagtatctttcagactaaaagtcggagatctgatcgattcgcatattatgcagctttatccgctgacctttgcaaaagatctgattgatgaattaacaaatcaggacggcggagaagagcctgtgaagactgaagaggtacagacgcccgtacaggaaaaaccggcgcctaatccgaattcggcacctgctcagacacagagacaggagcctgcgcctaaacggcaagggacggcaaaagtttcagagcctgtgcaggtggcaccggcagagtttcaatcctttgcccctcagactgaagcgcagccgcaccttcaaaaccttgacatgctcatggatattcctttgtccgtcacggtcgagctggggaggacaaaccgcagcgtcaaagaggtgcttgaactgtcaaccggcagtatcattgagcttgacaaactcgccggtgagcctgttgacatcttggtcaaccagcgcgtcgttgctaaaggcgaagtcgtcgtcatagacgaaaacttcggcgtcagggtgacagacattttgagtcaggctgaacgaatcagcaaattacgataataacagattgattggagagattaataatggcttacaagattttagtagttgatgatgcagcatttatgagaatgatgattaaagatattttggtgaaaaacggctttgaagtcgtcgcagaagcgcaagacggggcacaggctgttgaaaagtataaagagcattcacctgatcttgtcacaatggatatcacgatgccggaaaaagacggaatcacggctcttaaagaaatcaaggaaatcgatccgcaggcaaaaatcatcatgtgttcggcaatgggccagcaatcgatggttatcgacgccatccaggcgggagcgaaagactttatcgtcaaaccgttccaggctgaccgcgtcatggaagccatcaataaaacgctaagctaaagggtgtacaacttgtttaagaaacctcttattttcatagccggcctttgtctatgcgcctttctcgcattgccgtacgctccggctctcgcagaggaatcgggggaccagaccgttgatcatctgtttgagcaaaaaggtgcgggcaaagagaaagaaaaagcaaaagacaaagacaaaaccgaggaaaaaagttctctaaaggaagaggcggagaccgaacccccgtctccttccgtttccatatttgattttgtgaaaatgatcggcgcgttactgttcgtcatttttctgatctatgctttggtcaaattcatgaataaacgcaaccgtttgctaaaacccttccagtatgttgaaaacatcggcgggacttcactcgggcaaaacaagtccgtacagctgattaaagtaggaaacagggtgctggtcgtcggtgtcggcgaaaatatccagctgctgaaagagatcgatgatgaaaaggaatataaagaaattctcacgcagcatgaagctgcgatgaacagcaagattgaatggcagaaatggatggatcaagtcaaagttccaggcgtgcaaaaacaaagcggcacggcatctttttccgagtcgttaaaagcacagcttgcggaactgaaacaaaatcgcgcagaaggcagaaagaaaggccaaaatcaacatgaatgagtttatggatttatttaattcaagcgatgcggcaaatgtcagcgccagcgtccggctcttgctgcttttgacagtattttcgatcgctccgggtatcttgatcttgatgacttgtttcacaagggttgtcatcgtcctgtcctttgtccggacatcgctggcaacacagtcaatgcccccaaaccaggtgctgatcggacttgcactgttcctgacatttttcattatggggccgactttttcagagattaataaagaagcgctgacgcctttaatgaacaataaaatcaccttggatgaagcttatacaaaagcggaagccccgatcaaaacatttatgagcaagcatacaagacagaaagatctggctttatttatgaattacgcaaagatggaaacgcctgagtccatcaatgatattccgctttcaactatggttcctgcgtttgtcatctcggaattgaaaaccgcgtttcaaatgggatttatgatatttataccgtttctgattatcgatatggttgtggcaagtgttttgatgtcgatggggatgatgatgcttccgccggtcatgatttcactgccgtttaagattttgctgtttgtgcttgtagatggctggtatttaatcgttaaatctttgctgcaaagcttttagagtaggtgctaatacatgaattcagaatttgttatatcgatggctgaaagggctgtatacgttacattgcttatcagcgggccgcttttggcgctcgctcttctcgtcgggctgatcgtcagcgtttttcaggcaaccacccaaatacaggaacagactcttgcattcattccgaaaatcgtcgccgttttggtcggactcgtcgttttcggcccgtggatgctgtcgacgattttgtcattcgcgactgagctgttctctaatttaaaccgttttgcagggtagttttaacatgtcaataatcgaatcatttccagcctttttacttgtgtttgtcagaatcacagcattctatgtaacggtgcctctattttcttatcggacaattccggccgttcataaaataggttttgcattttttcttgcgctcgtcagttttcaagcgattgaaaagcctcctcaccttgacgttgacggaatttacatgatgttggccatgaaggaagcgctcatcggacttctgcttgggctgatcgcttacatgatgatctcagccgttcaaatcgccggatcgttcattgattttcaaatgggatttgcggtggcgaatgtgatcgatccacagacaggggcgcaaagcccgcttgtcggccagtttttatatacgatggcgctgcttctcatgctgagcctgaatgcgcatcatctcctgcttgacgggatctattacagctatcaatacattccggtcgacaagatggcgctgtcgtttggaagcgaagaatttgccgagtttatcgcaaaaagcttcaatacgatgtttattacagcatttcaattgtctgcgcctgttgtggcttgtttgtttttagtcgatctggcattggggattgtggcgagaacggtgccgcagctcaacgtgtttgtcgtcgggcttcctttgaaaatcgcgatcacctttatcatgctcatcatctgcatggccgttatgttcagcatgatgcagcacgtcttcgaatttgccattcggacaatgagagatctattaactttgcttggggtggcatgatgaagctgacgttggatttgcaatttttcgcaggtgaaaaaacggaaaaagcgacgccgaaaaaacggcgggaaagcagaaaaaaaggtcaggttgccaaaagtgcagatgtcaatacggcggtcactcttctcatcgtgtttttatcctttttattcatcggaccttttatgagagaccgcctgctcggcctgatcgaaaagtattacaaagaattaatcacgatgaaggtgtcagtcgccaatattcccggcctgtttcaaagtgttgtgcttgaatcgggcctcattatggcaccgcttttgctgacagccgtcgtctctggggtattgagcaactatatgcaagtcgggtttttatttgcccctgaagcgatcaagcctgatttgaaaaagcttgacccgcttaatggattcaagcggatttacagcatcagggcgatcgttgaactgcttaaatcgattttaaaaatcgtgattgtcggaggcgtgacattcgccgttttatggctgaactttgacaaaattctcagaatccaggcgctgtcggctggcgaggctttgtcatatgtcggctggctcacctttttaatgggggtttccgctgcagtcgcattaatttttctcgcggtgctcgattacctctatcaaaaatttgactatgaaaaaaatattcgcatgtcaaaacaggacatcaaagacgaatacaaaaaaaccgaaggcgatcctctgatcaagtcgaagatcaagcagaagcaaaaggaaatggcgatgcgccgcatgatgcaggaagtgccaaaagcggatgtcatcatcacaaacccgacccattacgccgtcgcattgaaatacgacgaaaacaaaatggatgcgccgtttatcatcgcaaaaggggtcgatctaatggctctgaaaatcaggcagatcgccaaagaacacgatgtcatgacggtcgagaacaggcctttggcaagggcgctctatgaccaggttgagatcgaccaggccgttccggaagaattctttaaggccgtagccgaaatcctggcctatgtttacaaaacaaagcaaaaaatctagtgaatttttcagttttaaaaggagagaaacagcatgtctgcaagagatttatctattttatccggcgttgtcctcattgtggcaatgcttatcataccctttccaacatggatgttgagcatcttaattatcgttaatatttctcttgcgttaatcgtgcttctcaccacaatgaacatgcaagaaccgctgcaattttcgatttttccttctttgctgctcctcttgacgctgttccgccttgggctgaatgtatcgacgacgcgttcgattctgtccaacggtgatgcgggaaaagtagtcgagacgttcgggtctttcgttgtcggcggaaacgttttggtcggtctcgttgtctttatcattttgatcattattcaatttatcgtcataacgaaaggggcggaacgggtatctgaagttgctgccagattcacgctcgacgccatgccgggaaaacagatgagcattgatgccgatttgaatgccggaatggtgaccgagcaggaagcgaaggtgcgccgtgagaaggtggcccgtgaagccgacttctatggagcgatggacggagcgagcaaattcgtgaaaggggatgcgatcgcagggatcatcatcgtccttatcaacgtcattttcggaattgtcatcggcatgctgcaaaaacaaatgagcattcaggaagccgcttcacactttacactcctgtctgtaggcgacggaatcgtatctcagctgcctgcgctcttgatctcaacggcgacgggtatcgtcgtgacaagagcggcgtcggacggaaacctcggccacgatattacaggccagctgtttgcctatccgaagcttttgtatgtcacggcgggaacgattttcctgctcgggattttcacgccgatcggcattctcctgacaggccctctggctcttcttctcgccgcaggcggctatatgctctccaaagccggtgaagagaaggaaaaagtggaggatatccttgaggaagaagctgaagtggatgaattaaaaagccccgaaagcgtcgtccatctgcttgatattgatccgatcgagtttgaattcggctacggattgattccgcttgcagatgcaaatcagggcggcgatctgttggacagaattgtcatgatcaggcgccagctcgcgcttgaactcggacttgtcattccggtcgtcagaatcagggataacatcgctcttcagccgaacgagtacaggctcaaaattaaaggaaacgaagtcgcgaaaggcgagcttctcctcgatcactttctggcgatgtctccgacaggcgaagacgatcagatcgaagggattgacacaatcgaaccgtccttcggtcttccggctaaatggataccggaatctcagaaagatcaggccgaaatgctcgggtacacggttgtcgatccggcttcagtcgtatcgacccatattacggagcaggtgaaaaagcacgcccatgagctgatcggaagacaggaaacgaaacagctgatcgaccacttgaaagaatcttatcctgtactggtcgaagaggtctcgccgaatccgctgtctgtcggtgacattcagaaagtgctggcaaaacttctgaaagaaaaagtatcgatcaggaacttggtgacaatctttgaaacgctggccgactacggaaagctgacgacggattcagatatgctgaccgagtatgtcagacaggctctggccaagcagatcaccgcccaatatgcgaaggaaaatgagacgctgaaagtggtgacttgttcgggccgcgtcgaaaaggccgtggcggaaggaattcagcagactgaacacggcaactttttatctcttgaaccaacattatccgaaaatatcattcaatctgtagcaagagaaatcgaacagctctcattgaggcaggaagtgccgatccttctatgttcgccgcctgtcagaatgtatgtcaagcagctgcttgagcgctatttccctgatctgccggttctttcctataacgaattggaagccaatgtagaagttcaaagcatcggagtggtggatattcaatgaaaatcaaaaaatttgtagctggttctatgcaggaagccacaaagcaaattatacaggagctcgggaatgacgccgtaatcttgaattctaaaaaaattcaaaagagaaaatttctcggctttgtgaaaaaaaccggggttgaagtgatcgcggtcgtcgaccaggacttttccgacgcaaggaagcaagagcgtcaaaagcccgttttccgggaacaaagcccttcgcctgtcccgcagccggaccatcttgatttggcaagccaagtgaaagagctgaaagaactgctggaaatgcggcatcatgagcagcctgttgatgtgctgcctgaaccgctgaaaaaggcggaccagctcctggcaaagaaaggggtatcgccggccatccgtacgaaagcgctcggccggttgatcagcacttctttaagagacggcgaagagtggacggatgaaaagacgctggcgcacttaacagatgctttggccgatcttcttcccgataatctggaacaggacgtggcgattcattcgcaatatgtcgtgctcttcggatcgaccggagtcggcaaaacgacgacattggcaaagctcgccgcttcttctgtactggaaaagcagaaaaaaatcgcttttatcacgaccgatacgtacaggattgcagcggttgaacagctcaggacatatgccgagcttctgaatgcgccgcttgaggtgtgctacacgaaagaagagtttaaagctgcccagcaaaagttcgccgattttgaccacgtcttcattgatacggcgggccggaatttcaaagacgggcaatatgtcagggagctgaaggaaatcattccgtttgagcgtaagatacaggcgtttctcgtcatgtccgcgacgagcaagtacgaggatatgaaggagctcattaagcagttctcaagcattccgatcgatcagttgatattcacgaaagtggatgagaccgattcgttgggaagcgtcatgaatctgctcgccgaatcgagaatcggcctcggctatattacaaacggacaaaatgttccggaggatatccgctacttgtcaaacgcagcatttgtcagactgcttacggggtgttgaacatggatcaggcagaaagcttacgaaggcggatggggcaacgctttgccgaaccgcccgccgctatcgctcatccaaaagcgaaaacgctcgctgtcatgagcggaaaaggaggcgtcgggaagtcgaatgtatcgctgaatacggctctcgccattctggaaaaaggaaagagcgtgctgttgatcgatcttgatgtcggtatggggaacattgatattctgatcggccggcaatcgctctacacggtgatggacctcctccagcaaaaaatgccgtttgagcgcgccttgtcagccggcccgcgaggccttcaatacatttcgggcggaaccgggctggatgcaatgttcgaattgaacagggaaaactgggcgttttttctgaaggaattgacgcgggctttgacaagcttcgactatgtcatatttgacatgggagcggggctgtcaaaagatcagctgcctttcgtcctgtcagcggatgaaattctggtcgtcaccacgccggagccgacatccatcatggacgcatacagcgcgatcaagcatttggcattaaccggacgcgatcttcagctgaaagtcgttgtcaatcgctgtacaacccaaaaagacggaatttctgcttttctccgcctttccaacacggtaaacgcttttttgcagcaaaagcttgcatatgcagggccgattcctgaggatcccctggtctcaagagccgttgtggagcagcagccgtttctgataaagaatccgcgttccaagccgagcagggcggtttacctgctggccgaatcgctgcttcataacggcagaacggaaatgggcgaaaaccggtcctttatcgaaaaattatcttcattcctgaggaggggcaatacattatgattcgtgttcttgtcgttgacgactctgcttttatgagaaacatgatcaccaagtttttaacatccaatcacgagattgctgtagcaggaacggcaagaaacggcgaggaagcgctccaaaaaatcaaggagctccgtccggatgtgatcacattggatattgaaatgcctgtgatgaacggaaaagaaacgttgaaaaggattatggcgagcgatccgcttccggttgtcatggtatcgagcctgacgcagcagggagcagatatcacgatcgaatgtctggagcttggggcgatcgatttcgtcgcgaagccgtcgggttcgatttcaatagatttatataaagtaagagacatgctgattgagaaggttttgacagcaggacgggtgaaactgaaaggccggcaagttccgatctcaaagcccgccatcgagacggcgaagcagccgattgtgggcggcagcgattcagtccgctttcgggctggaaaacagctcatctgcatcggtacatcgacaggggggccgagggcgctgcaaagagtgcttcccaagcttcccaaaacgttgaaggcgcctgtttttatcgttcagcacatgccaaagggctttacggcctcattagcgaacaggctgaaccacctctcagaagtaaccgtgaaggaggctgaaaacggtgagagagcgaaagacggctgggtttacattgcacccggaggaaaaaacatggcggtcggccttgaaaagggcgaattggtgatcacgctcgatgaccgcgacacagaaagccgccacaagccttctgttgactacttgtttcaatccctggcctcacttcgggagtttgaaaaaatcgccgtcattatgacggggatgggaagcgacggaacagaaggcgtaaaaggccttttgaaacatgggagcggaacggtgatcgccgaagcagccgagtcgtccgtcgttttcggaatgccgaaatcggtcattaacaacgggcttgcaaacgacatcaagcatgttgatgagattgccgcagccattatgacgtatatgaaaaaagagagggcgtgactcatatggatatgaatcaatatttagacgtctttattgaagaaagcagagaacatttgcaaacctgtaacgaaaaattgctcgaactcgaaaaaaatccgacagacttgcagcttgtccatgatattttcagagcggctcataccttgaaagggatgagcgcaacgatgggctatgaagacatggctcatttaacgcacagtctggaaaacgtgctggatgcgattcgaaatgaagaaatgaccatcacgtcagagtggatggacgtcatgtttgaagcgctcgatgaccttgaagcaatcgtcctttcgatcatcgaaggcggcgacggcaaaagagatgtttccgaagtctgcgccaagcttgatgtgacaggggcaaacaaggaggcggcagcagcggcagaagcgcctgaagcggcgtcttccgaaacgaaatggtcctatgacgaatttcaacgaacggtcatcgccgaagctgaggaacaaggctttaaatgtttcgaaatcaaagttgcattgaaagaggactgtctgttgaagggcgttcgggtgtacatggtatttgagcagctgaacgaggtcggcgaagtcgttaaaacgattccggaaacagaagtccttgaatcggaggattttgattccgaattcgtcatctgctttttaagcaaacacggaaaagaagagattttcaacaaaatcaacggcgtatctgaaattgaaaaaatagaagtgaccgagctgaaaaacgatttttcggcacaagaagaagcgaagcccgccgcatccgaaaaagaaaccgcaccgaaagaggcggagaaaaaaccggctaagcagccggacggcaaaaaagacgcggcgaaacctgcggcaggcggcggaacgaagacgatccgcgtcaacatcgaccgcctcgattcattaatgaacctgtttgaagagctggtcattgacagggggcgcttagagcagatcgccaaagagctagaacacagcgaattaacggaaaccgtcgaacggatgactagaatttcaggcgacctgcagtcgatcatcctcaatatgagaatggttccggtagaaacggtgttcaaccgattcccgcgcatggtccgccagctgacaaaagaattaaataaaaagatcgagctgtcgattttcggagcggaaacagagcttgacagaacggtaatagacgaaatcggcgacccgcttgtccacctcttgagaaacagccttgatcacgggatcgaggcgcctgaagtcagggtgaaaaacggtaaacctgaaaccggtcaagtccgcctgaaagcataccacagcggtaaccatgtctttatcgaggtggaggatgacggcgccggcatcaaccgcaaaaaggtgctcgaaaaagcgcttgagcgcaacgtcattactgaacgcgaagccgaaacgatcgaagatcatgaaatcgacgcgctcatttttgcgccgggattctcaaccgcagatcaaatctcggatatttcaggacgcggagtcggcttagacgttgtcaaaagcaagctggaatcgttgggcggttctgtcagcatcaaatcgagcgaaggcgaaggttcgcttttctccatccagcttccgcttacactgtcgatcatttccgtgctgttagtcaaacttgaaaatgaaacgtttgcgattccgatttcttctattatagaaacggctgtcatcgataagaaagatattcttcaaacgcacgaccgcgaagtgatcgatttcaggggccatatcgtaccggtggtttacctgaaagaacagtttaatgttgaggattcttcagatgatcttgatcagcttcacgtcatcgtcgtgaaaaaaggagacaagctgacggcatttgttgtcgactcctttatcggccagcaggaagtcgtattaaaatcactcggcgattatttaacaaacgtctttgccatttccggcgcgacgattttgggagacggacaagtagccctgatcatcgactgcaacgcccttattaaatagaaagcgaaaggagagcgatcctcttgaccacacagactaccaccggtgagaaaatgattgtgttcaaagtaaatcataaagagtatgccatctctgtatcagaagtaatgtccattgaaaaatggcagcagccaacaagggtgccgggagtggaaccgtatatttgcggcgtcattaatttgagaggtgttgtcacacctgtcatcgatttaagaaagcggattgaagcgcctggagacacgattactgatgaaacgagaatcatcatcatcacccatcaggacattgaagtcggctgggtggtggatgaggcgaacgatgtcatcacagtcgaggaagaggaaattgaatcggctcccgaaacggtaggaaaagacggcaggcaatggattaaaggcatcgtcaagcaagggtccagacttctcaatctgattgactctgaagctgttttaaaccggaagtcgagccttgccgccgcttctgaaaatgtgaagaaataaggagccaatgatgagcgtatttaacggaattagagaagagcatcttgatatattgcgggaagtcgggaatatcggagcgggccattccgcttccgccctggccctgttgctgaacaggaaaatcgaaatggaagtgccgtttgtcaagctgatgtcgtttgatgagcttgtcaacctattcggcggtgcagatcttcctgtcgcaagcatctttttgcgcatggaaggggattttccaggttctatgttcgtgatcatgcctttttcagaggccgagcagctgatcagggagcttgtcggcaatccggaattcgagattgacagcatgacgccgaacgatatcggagcctctgccctgcacgaactcggaaacattatggcgggatcttatttgaccgctctcgctgatttgacaaaccggcaaatgtacccgagcgtcccagaactgacgctagatatgttcggagccgtcatcagcgaagggctgatcgagctcagccaagtcggagatcaagttatcgtgatcgacaactccatttttgacgaggagcacaaccggaaagttaaagcgcatttgttccttctgccggactatgattcttttgaaaagctctttcatgcattgggtgcagcgctatgaaaatcttagaaaaagaaacatcgattatcagagtgggaattgccgatgtaaaaatcgtccgcactcccgacaagatcagaacatcgggtctcggttcgtgcgtcgggctcgtgctgtatgatttggaagcaaagacggccggtctcgtccacgtcatgcttccggactcttccttatccaagacgccggacatcaacgtggcaaaatacgcggacacagccgtcgaagcgacggtcaagatgctgcttgaagccggatgccgaaaatacgctttgaaagcgaaaatggccggaggagccgaaatgtttaaatttaagatgacaaatgatttgatgaaagtcgggccaagaaatgtgcttgcgattaaaaaacatctatctctcttaaacattccgattgtaagcgaggatacaggcggaaacagcggaaggacgatcgagttcgatccgcaatcagctgaacttgtcatccggacagttaaacaaggtgtaacaacgatttaataagcaatatagggggataaagatgcaatccttgaactatgaagatcagatgctttggtcgcggtggaaagaatggaaagatcctcaggcaggcgatgatttaatccgccgctatatgccgcttgtgacatatcatgtcggccggatagccgtcggcttgcccaagtccgttcataaagacgatttggtcagccttggcatgctgggtttgtatgatgcccttgaaaaatttgatccgggaagggtatttgaagtttgatacatacgcttccttcagaatcagaggcgctatcatcgacggtcttcgcaaagaagactggcttccgagaacgtcccgtgaaaaaacgaagaaagtggaagcagcgatcgaaaagctcgaacagcgttacttaagaaatgtttcgccgagcgaaatcgcagctgagctgggaatgagcgaacaagacgtcgtgaccacaatcaatgaaggtttctttgcgaacctcctttcaattgatgagaagcttcacgaccatgaagacggggagaacgtccaggtgatgataagggacgacaaaacgagcacgcctgaagaaaaaatgctcaaagacgaactgatctcccagcttgcggaaaaaataaacgagctatcagaaaaagagcagctcgtgatcagcttattctataaagaagagctgacgctgacggaaatcggacaggttttgaatttgtcgacttcccgtatttcacagattcactccaaggcgcttttgaaattgaagcatctgctggataaagtggtacaatagcatgtaagctgccggcatgaaaccggcagcattttttaagcgtccgacgggaagtctttttttgattaaatttcatggttagcgagtgaaaaatatgtcaacaatattatggcttgtgagcttcacgctccacggtatattgatttatttcgtcatcattttgaatacgaggctcagcgctttcaaggcagcggagaaagagcaaaaacagcttttggaagaaaccgagaatacattgaccgcttttttgatggagttaaaagacgaaaatgaaaaactcgttcaagagattcgggcgaatgccgaaaaagagccgcaaagaccggaaacacagcctgaaattcccgctcaaacccccgtccttccggaagcggacgaatcgcgcgatctgccgcttcacatcgaagcgatgatcaatgaggtggagcaggaagaggatgagctcaatcaaaaggagcaggaagcatccatatcctatgaagaagaagctctcgcattatatgaaaaggggctctctccggaggaaatcgcaagacagctgaaaagcgggaaaacagaaatcgagcttttcttaaaatttcgcggaaagctcaaaaacgattcttgattgtcgagaaagcttatgttatattatttcttggtgttaattacacacgcttaacgatttatgcaagcggtgctgtgcgattctcgcgtgcagtcctgcataaaaatgacctaagcggaggaaaaaaaccattatattaggaggaaataacacatgtcagtcatttctatgaagcaattgcttgaagctggtgttcacttcggccaccaaacgcgccgctggaacccaaaaatgaagcgttacatcttcacggagcgtaacggaatctacatcatcgatcttcaaaaaacagtcaaaaaagttgaagaagcatacaacttcacgaaaaaccttgcagctgacggaggaaaaatccttttcgtcggtacgaaaaagcaagctcaagactctgttaaagaagaagcggaacgttctggaatgtactatgtcaaccaacgctggcttggcggtacattaacaaactttgaaacgatccaaaagcgtatcaaacgccttaaagatatcgaaaaaatgcaggaaaacggcacatttgacgtacttcctaaaaaagaagtcgttcaattgaaaaaagaattagagcgtcttgaaaaattcctcggcggaatcaaagaaatgaaagagcttcctgacgcactgttcattatcgatcctcgcaaagagcgcatcgcggttgcagaagcgcgcaaactgaacattccgatcatcggaatcgttgacacaaactgcgatcctgatgaaatcgatgttgtcatccctgcgaacgatgacgccatccgcgctgttaaattgctgacttctaaaatggcagatgccatccttgaagcaaaacaaggtgaagaatcagctgaaacagaagcgaaagaagcagaaacaactgaaacaacaactgcttaacctggtcaaaaggtgataagggggtctgccttttatcaccttttttttcaccagatcaacatttacatattttgtttgatatataaggaggaaatcaaaaatggcaattactgcacaaatggtaaaagagcttcgcgaaaaaactggcgcaggcatgatggactgcaagaaagcgttaactgaaactgacggcaacatggataaagcgatcgatcttctaagagaaaaaggaatcgcaaaggctgccaaaaaagctgaccgcatcgcggctgaaggtttgactttgatcaaaaccgacggcaacacaggcgttattcttgaagtgaactctgaaacggacttcgttgcgaaaaacgaaggcttcaaggagcttttgaacgacctggctgaccacattctggctgaaaagcctgaaagcgttgaagctgctatgggtcaaaaaatggctaacggttcaactgtagaagaatacatcacaagcgcggttgctaaaatcggagaaaaaatcacgcttcgccgcttcgctgtcctgacaaaaggcgatgacgctgcattcggcgcatacctgcacatgggcggaaaaatcggcgtattgactgtccttaacggcacaactgacgaagaaacagcaagagacatcgcaatgcacgttgcagctgtaaaccctcgcttcatttcccgcgaccaagtgtcagaagaagaagcgaaccgcgagcgcgaaatcttgactcagcaggcgcttcaagaaggcaagcctgaaaacatcgtcgcaaaaatggttgaaggccgcctgaacaaatatttcgaagaaatctgcctgcttgatcaagcgttcgttaaaaacccggatgaaaaagtgaaacaggtcgttgctgcgaaaaacgcaacggttgaaacgttcgtccgctacgaagttggagaaggtatcgaaaaacgccaagaaaactttgctgaagaagttatgaaccaagtgaaaaaataagattgaaaagccgcttgccataaaacacacggcaggatcttttcaaggaaaataggggacacaatttgtgtccctatttttaaaacagtttacaaacctttttttctcttgcataataaataacggcaagcatgcacttggaggttattatggaaaaaccaaagtataatcgtatcgtattaaagcttagcggagaagcccttgcgggtgaacagggaaacggcatcaacccgaccgtgatccagtccatcgccaaacaggtgaaagaaatcgccgagcttgatgttgaagtggcggtcgtcgtcggcggcggcaacctgtggcgcggaaaaacgggcagcgatctcggaatggaccgcgcaacagcggactacatgggaatgcttgcaacggttatgaattcccttgcgctgcaagacagccttgaaacgctcgggattcagtcaagagttcagacatccatcgaaatgaggcaggtcgctgagccatacataagaagaaaagcgattcgccatcttgaaaagaagcgcgtcgttatcttcgctgccggtacaggcaatccatacttctcaacggatacgacagcagcgctcagagcggctgaaatcgaagccgacgtcatcttaatggccaaaaataatgtcgacggtgtatacaatgccgatcctagaactgacgaaacagccgtaaaatatgaaaaattgtcttatctcgatgtgttgaaagacggtttggctgtcatggattcaaccgcttcttcactttgcatggataacgacatcccgctgatcgtcttttctattatggaagaaggaaatattaaaagagccgttttaggcgaacaaatcggtacaatcgtaagggggaaataacgtgtcaactcaagtgatgaatgaaacaaaagaacggatgcaaaaagcgataagcgcttatcagcgcgaattggccactgtccgcgcaggacgtgcaaatccgtcattgctggacaaagtggcagttgagtattacggagcgcagacgcctttaaaccagattgcgtccattacagttccagaagcgcgcatgctcgtcatcacaccatatgacaaaacggcgctcggcgatatcgaaaaagcgattcaaaaagccgacctcggtgtaactccgtcaaacgacggcaatatcatccggatcacgatccctcctctaactgaggagcgcagaaaagagcttgccaaactcgtgaaaaaatattcggaagatgccaaagtcgcggtccgcaacatccgccgcgatgcaaatgacgatctgaaaaaactagagaaaaatggtgaaatgactgaggatgaattgcgctcttcaacggaagacgtacaaaagctgacagatgaatatgtgtcaaaaattgatgagatcacaaaagataaagagaaagaaatcatggaagtttaatgaaaaactctgtacaatagataatagtgaaaagaccctctcatgtttacagggggtttttttgttaatactgttgttatctagaacgatataacaggaaagcaaccttttgggtgatggaggactctcatgctcaatatactcaaaaattggaagaatcagcattcggctgcttccaacatggaatgttacacaaaagaaaatattttaaaaggagaaattcctgaacatatcgccattattatggacggaaacggccgctgggcaaagaagcgggcgatgccccgcatcgcgggtcatcacgaaggcatgaaagtggtcagacagacgacaaagcttgccaatgagctcggtgtcaaagcgttgacgctgtatgccttttcgacggaaaattggaagcgtccaaagcttgaggttgactttctgatgaagctgcctgaagagtttctgggaacgtatctcccggagctggtcgaagaaaatgtccgggtccgcatgacaggcgatagggaaggactgccgccccacacgatccgcgcggttgaaaaagccatccgtgatacggagaacaatgatggacttattcttaattttgcattgaattacgggggacgtgcagaaatcgtcagagccgcaaagaaaattgccgaagaagccaaaaaaggcacattgaataccgaggaaatcgacgaaaagctattttccgattatttaatgacagaaactttgcaggaccctgatttgctgattcgcacaagcggcgagatcaggctgagcaacttcatgctttggcagcttgcctacagcgaatttttatttaccgatgtattgtggcctgattttaaagacgttcacttgcttcaggctatcggagaatatcagcgtcgcgggagaaggtttggcggaatttagaggatggtgcagatgaaacagagaatattgacgggtgtgatcgcggcagcggtttttctgccgctcgtgattttcggcgagctgccgttcgccctgctagtttatgcaataggtatacttgctctatttgaacttttaagaatgaaaggcctgaagctgatcagcgctccgggtatcatcagcatgctgctgttggcggttttgctgtgtccaagccaatacgcggaagacgctgggctgggtataaccaaaggggaggtcgtctttttggcggtccttttgcttttggcatatacggtgctcagcaaaaactcgtttacttttgacgaagcggcattcgtggcgctggcagcagtttatatcggattcgggttttattactttattgaaatcagaaacatcggactcagctatgtcttttttgcgatcggcgtcgtctggtcaacagattccggcgcttattttatcggaaaggcgtttggaaagcggaagctctggcctgaaatcagccctaacaaaacggtagaaggcttttggggcggaattttgacagcggtcgttttttccgcgatttatcaggccgccacaggttttccgcacgcttatctgtttgtgctgatcattaccgtgcttttgtcaatcgtcggtcagatcggcgatttggccgagtctgcgttcaaaaggcattaccaggtgaaagactcgggccggatcctcccgggacacggcggaatgctggaccgctttgacagctttttatttgtcatgccggttctgtacttcctgcttgttctttttcagccgttcgggctatgatagaaaagggtactgatagctagaaagaaacagaggtgcggcaattttgaagaacatatgtctattgggagcgacaggctccataggagaacagacgcttgatgtcatcaaagcgcatgacgataagtttcggctgaccgccatgactttcggcaaaaacgccgaaaaagcggcagaaatcattgaaacctttaaaccgaagtatgtaggcgttggggatgagcatacatatgaaacattaaaacagcattctttctcctacacctttaaaacagggatcggggaggaagctttaatcgaagcggccgttatcccggaagcggatatcgtcgtcaatgctctcgtcggcagcgtcggtcttcttccgactttaaaggcgatggagcataaaaaaacaattgcgcttgcaaataaggaaactctcgtgacagccggtcatatagtgaaagaacacgcccaaaaatacgatgtcccgctcctgcccgtcgacagcgaacattccgcgattttccaggcccttcagggggaaaatccgaagcatatcaaacggctgatcgtcacggcttcaggcggcagcttcagggacagaacaaggcgggaacttgaaggcgtcacagtggaagaagccctcaatcatccaaattggtcgatgggtgcaaaaatcacgatcgattcggctacaatgatgaataaaggactcgaggttattgaagcccactggctgtttgatctgccctatgaccagatcgatgtcctccttcacaaagaaagcattattcattcaatggttgaattccacgaccgcagcgtcatcgcccagcttggcacacctgatatgagagtgccgattcaatatgcgctcagccatccggaacgcctgccgtttaatgaagcaaaatccctcgatctctgggaagtcggacagctgaattttgcccaagctgattttgaaaggttccgctgcttacaattcgcttatgaatcaggtaaaataggcggtacaatgccgactgttttaaacgcggccaacgaggaagccgttgcggcatttctttcgggcaggatttcctttctcggaatagaagacatcattgaaaaggctttggaacgccatcaggtgatcgcaaagccgagccttcaagagatccgtgaagtggacaaagacgccagaaagtttgtccaaacattactcacataaggtggtatgttcgtgaatactgtgatcgcgtttattcttatttttggaacgctcgtatttttccatgagcttggtcatctcatccttgctcaaagagccggaatactgtgccgggagtttgctatcggcttcggtccgaaaatcttttcgtttaagaaaaatgagaccgtttatacgatcaggcttcttccgatcggcggctttgtcagaatggccggcgaagatcctgagatgattgaagtgaagcccggttatacggtcgggctgttgttcgacagcgaaaacaaggtcgaaaagatcattatcaaccaaaaagaaaagtatcccgacgcattggtcattgaagtggagcaggccgacctggagcaccagatgaggattacgggctatgagcacggcaatgaagatcatctctcttcattttctgtcagtgaaacgtcctttttcatcgtagacggggaagaagtccagatcgctccttacaaccgccaatttcattcgaaaacggtttggcagcgcatcaaagcgattgctgccggaccgatcatgaactttattttggcttatgtcatactcgtgatgctcggactgatgcagggagtgccgtctgacgagccggtgctcggcaagttgatagacaacggacgggcggcggaagcaggcctccaggagggagaccgcattcaaacgatcaacggggagaacatgaggtcgtggacggatattgtcaacacggtcagagaacaccctgaaaaagaactgaaaatcgttttgatgcgcgacaatgtcaagctgacgaaatacgtaacacctgaagctgtcaaggcaggggatgaaaccgtcggcagattcggcgcttacaatcctgtgaaaacaggcgttctgacatcgatttcctacggtgcgaccgaaacggcgacagtggcccagagcatcgtcaccaatctcggaaagctcgtcacaggacaattctcaatcgacatgctggccggtcctgtcggcatttatgacatgacagaccaagtggccaggacaggcgttatcaacctgctgaagctggccgcatttttaagcatcaacctcgggatcgtcaaccttctgccaatccctgcgctggacggcggaagactgttgttcctgtttattgaagcgatccgcgggaagccgatcaaccgcgaaaaagaagcgtttgtcgtctttatcggcgtcgcatttttgatgctcctaatgcttgtcgtcacatggaacgatatccagcgcttatttctgtaaaaccaatcgccttttttaagtgcagccaagccttttaaaaggctcttttttagggacaccgttcccgactcaaaaaagtaaccaactgaaacaaatgaggtgcgaatgaatgagacagagcaggactttaattcctacgctccgcgaagtgccggctgatgctgaagcgaaaagccatcagcttcttctcagagcagggtttatcagacaaaacacaagcggtgtatacagctatatgcctcttgccaataaagtcattcataaaatccagagcattgtccgcgaagaaatggagaaaatcaatgccgtcgaaatgctgatgccggcgctccagcaggcggaaacttggcaggaatcgggaagatggtatacgtacggtcctgagctcatgaggctgaaagaccgccacggccgtgaatttgccctaggcgcaacacacgaagaggtcatcacaagcatcgtcagagatgaagtgaaatcgtacaagcgccttccgctgaccctttaccagatccaatcgaagttccgcgatgaaaagcgcccgcgcttcggtctgttgagaggccgggaattcatcatgaaggatgcgtattccttccattcctccgccgaaagccttgatgaaacgtacaatgatatgtatcaggcgtatacgaatgtgtttacgcgctgcggcctgaatttcagaccggtcattgcagactcaggcgcgatgggcggaaaggatacccatgaatttatggcattgtccgatgtcggtgaggatacaattgcgtattctgatcagtcttcatacgccgccaacattgaaatggctgaagtgaaggaaacagatgccggcgagcaggcagaaatgaaagagctgcaggaagtccacacaccttcggtcaaaacgatcgaagaggttgccgcatttcttggcatatccccgtcagactgcattaaatcaatgctgatgaaagcagacggacgttttgtcctcgtcttgacgagaggggatcacgaagtcaatgatgttaaggtgaaaaacctgcttcaagcagaaataatcgaattcgcgagcgccgaagaggttgcagagataacaggcactgaacccggttttgtcggaccggtggggctcgaccgcgaaatcgaaatctttgcagactttgctgtgaaggcgatggcaaacgcagcagctggagcgaataaaacagattaccattatcaaaacgtgaatatcagccgggatgcgcacaatgtgacattcgccgatctccgctttatccaggaaggagacccttcaccggatggaaaaggaacgatccgttttgcaaaaggaatcgaagtcggacaagtctttaagctcggcacccgctattctgaagcgatggacgccacataccttgatgaaaacggacgcgctcagccgatgctgatgggctgctatggaatcgggatttcccggacgctttcggccatcgttgagcagcatcatgacgataaaggcttgatctggccgctggaagtgacgccgtatgacctgcatatcctcgcgcttaatatgaaaaatgacgcgcaagttcagcttgccgaaaagctgtatgaagaatttaaagcgaacggctatgacgtactgtttgatgaccgtgccgaacgggccggcgttaaatttgcagattccgatttgatcggtctgccgatccgcatcacggtcggaaaaagagctgacgaaggcgttgtcgaagtgaagatccgcaaaaccggagaatcctttgaaatcgctgctgatgagctgtttgactttatcgaaaaacaagtcaagagcttatcttctcactcttaaaacatggtaaactagagtaaaggaaggtacctcgggaatcgtcccaaggtaccttcaattatgattttcttttagggaggaatctgtcttggaagaccagctttctgtcaacagaagacagtttcaaattcttctgcagcagctgaatgtaacggaagatacgatgatccgccaccttgaaggcggacaaatcataaagctgaccgttcataaaaacaagaagacatggcactttcactttaaattgagaaatgtgctgccttatcaaatcttcgaacggtttcacagccagctgacccgcaccttttcccatatcgcccaggtcacctgttccatcgaggcggaaaacccttcgattgacgagcagcttgttcaggattactggacgcgctgcattcaggaactcgatggtatttctccgccgatcttggcgcttttgaacgaccaaaagcccaagcttacgggaaacaaaatcctgcttaaaacgaaaacagatacagaagcgtccgctttaaaaaagaaatacagctcgctcatccagtcaagctaccgcacattcggctttcctgagctccagctggacacagaaatttttgtatcagatcaagagattcagaaattcagagagcaaaaaatggccgaagatcaagagagggcccttcaggctttaatcgaaatggagaagcaggataaggaagcacaagacgatgaagcgccggcaggccctcttcagatcggctaccagattaaagactctgaagaaatcagaacgcttgacagcatcatggatgaagagcggagaattacggtgcaaggctatgtattcgacgctgaaacaagagagctgaaaagcggcagaacgctttgcatctttaaaataaccgactatacaaacagcattctcgtcaaaatgttcgcccgcgaaaaagaagacgctgtattgatgaagtccctgaaaaaagggatgtgggtcaaggcgagaggaagcatacaaaacgatacattcgtccgcgatttggtgatgatcgccaacgatgtcaatgaaatcaaagcgaaaacccgtgaggatacagcgccagaggacgaaaaacgagtcgagctccacctccattcaccaatgagccagatggatgccgtatcaagcatcggcaagcttgtcgaacaggcgaaaaaatgggggcacccggctatcgcgctcactgaccatgccgtagtccaatcgtttccggatgcattcgcggcaagcaaaaagcatggcgtgaaaatgatctacggacttgaagccaacctcgtcgacgacggcgtgccgattgcctacaatcccgtgcaccgtctgcttgaagaggaaacatatgtcgtgttcgacgtcgagacgacggggctgtctgccgtctatgatacaatcatcgagctggccgccgttaaagtaaaaggcggggaaatcatcgaacgctttgaaaggtttgccaacccgcatcgacctttatcggctacgatcatcgagctgacggggattaccgatgatatgctgaaagatgcgcccgaagtcgaagaggtcatccgcgattttaaagaatgggtcggtgatcacacgcttgtcgctcacaatgcaagctttgacatcggcttcatcaatgtcgcctataagcgcctgctgaattcggagaaagtgcagaacccggtcattgacacgcttgagctgggccgttttctttatccggaattcaaaaaccacaggctgaatacgctttgtaaaaagtttgacatcgagctcacccagcatcacagggcgatttatgataccgaagcgacgggttatctccttgtgaaaatgctgaaagatgcggccgaaaaaaatatcctgtaccacgatcagctgaatgaaaatatggggcagtccaatgcctatcagcgttcaaggccatatcacgcgacacttttggcggttaatgagacaggcttgaaaaaccttttcaaacttgtttcgctgtcgcatatccattatttttacagggtgccgaggatcccaaggtcacagcttgaaaagtacagagaagggcttttaatcggttcggcgtgcgacaaaggcgaagtatttgaaggcatgatgcagaaatcgccggaagaagttgaagacatcgcttcattttatgactaccttgaagtcatgccgcctgaagtctaccggcacctgcttcagctcgaactcgtcagggatgaaaaagcgttaaaagaaatcatcgccaacatcacaaagctcggcgagaagctgaatatcccagtagtagcaactggaaatgtccattatctgaaccctgaggacaaaatttaccggaagattctagtttcctcgcaaggcggcgcaaatccgctcaacaggcacgagctgccgaacgttcatttccgttcgacggatgaaatgcttgaggccttttcatttttgggtgaggaaaaagcgaaagaaatcgttgtcaagaacacccgcatgatcagcgagcgaatcgaagaaatcaagccgatcaaagacgatctttacacaccgaagatcgaaggcgcagatgacgaaatccgccgcatgagctatgagaaagcaagaagcatttacggcgaggacctgcccgaaatcgtcgaaaaacggatcgaaaaagagctgaaaagcataatcggccacggattcgccgtcatctatctgatctctcataagcttgtaaaacgctcccttgatgacggctatctcgtcggttcgaggggatcggtcggttcttcccttgtcgcaacattgacggaaattaccgaggtcaacccgctgccgccgcattacgtctgtccggattgccgccattccgagtttttcaacgacggatcggtcggttcgggatttgatttgcctgacaaagactgtccgaagtgcggagcggcctacagaaaagacggccacgacattccgtttgagacgttcctggggtttaaaggggacaaggttcctgatatcgacttgaacttctcgggcgaataccagccgcatgcccacaactatacgaaagtcctgttcggagaggataacgtctaccgtgcgggaacgatcggaacagtcgccgaaaaaacggcttacgggtatgtcaaagggtatgcaaacgacaacaatttgcatatgcgcggggcggaaatcgaccgacttgtccaaggctgtacaggcgtcaagcggactacagggcagcacccgggcggaattatcgttgtgccggattatatggatatttacgacttttcaccaatccagtttccggcggatgccacagattccgaatggaagacgacgcattttgacttccattccatccatgacaaccttctgaagcttgatattctcggacacgatgatccgacggtcatccgtatgctccaggatcttagcgggattgatccgaaaacgattccgaccgatgatcctgaagtgatgaaaattttccaagggacagagtctttaggggtaaccgaggaacagatcggctgtaaaaccggtacactcggcatccctgaattcggaacccgctttgtcagacagatgcttgaggacaccaagccgacgacattttccgagctcgtacagatttccggcctgtcacacggtacggacgtatggctcggcaacgcgcaggagctgattcacaacaatatttgtgaactgagcgaagtgatcggctgccgtgatgacattatggtgtacttaatctaccaggggcttgagccatccctcgcctttaagattatggagtttgtccgtaaaggaaagggactgacgcctgagtgggaagaagaaatgaagaataataatgttccggactggtatatcgattcctgcaaaaaaatcaaatacatgttcccgaaagcccacgctgcggcatatgttttgatggcggtcaggatcgcttattttaaagtccatcatccgctgctctactacgcagcatacttcaccgtgcgggccgacgactttgacatcgaaacgatgatcaaaggatcgacagcgatcagagccgtcatggatgatatcaactctaaaggccttgacgcttctccaaaagagaaaagtttgctcacggtgcttgagctggcgcttgaaatgtgcgaaaggggcttctctttccaaaaagtcgatttatacagatcgagcgcttcagaattcatcattgatggaaacagcttgattccgccgtttaattcaataccggggcttggaacaaacgccgccttgaatattgtcaaagcgagggaagaaggcgaatttctttccaaagaagatttgcaaaaaagaggaaaggtgtcaaaaacgatcatggaatacttggagcgccacggctgtctcgagtcgcttccagatcagaaccagctgtcattattctagaaactgcctgcttaaagcaggcagtttttttatctgttttacggcataaagagcgttttttcggaattgggtgacaaatgccaggggagaaatgatcacaaaaaaataaagggctgtcagatctgttgacaataaataaacatcaatgttagaatttccaaaatataacacttcgtttggaatgtgctgtctattagatttctactctcataacttagtttattgaacaaataaactaagttacttatcaaattcctcgcttgcagtcgtgtgctgatttaatgtgcaatcaatatcttcggtttttcaactttggccttgttttgttcgccggcaaatctaaaaggaggtgagcatgttgtagacagatggagttgcttgatcttaacgaacatgatggggaggaagcagtacgtgaaacagaaagtatttttaaaaatgaaagcgctttgtttggcacttttagtgatcttctctatgagcatagcgtcgttttcagaaaagacccgtgcagcttctgctgaagaatatcctcataattatgctgaactgctgcaaaagtctttgttattttatgaagcacagcgctcgggaagacttccggaaaacagccggctgaattggagaggagactccgggcttgaggacggaaaagacgttggcctcgatttaacgggagggtggtatgatgccggcgaccacgtgaagttcggtctgccgatggcttattctgccgcaatcctgtcatggtcggtctatgagtaccgagatgcctacaaagaatcgggtcagcttgatgcggcgctggacaatattaaatgggcgacagactactttcttaaagcccatacggctccttatgaattgtggggccaagtcggaaatggcgctctagaccacgcatggtgggggccggccgaagtaatgccgatgaagcgccctgcctataagatcgatgccggctgtccggggtcagaccttgctggtggtacagccgcagcgctagcatcagcatcaattattttcaagccgacagattcttcttactctgaaaaattactggctcatgccaagcaattgtatgattttgccgaccgctaccgcggcaaatattcagactgcattacagacgcacagcaatattataattcgtggagcgggtataaagatgaactgacatggggagctgtctggctctacttggcaacagaagaacaacaatatttggataaagcccttgcttcggtctcagattggggcgatcccgcaaactggccttaccgctggacgctttcctgggatgacgtcacttacggagcacagctgctgctcgctcgtctgacaaacgattcccgttttgtcaaatctgtcgaacgcaatcttgattattggtcgacaggctacagtcataatggaagcatagaacggatcacgtatacgccgggcggtttggcctggcttgagcagtggggatcattgcgatacgcttcgaatgccgcttttctcgctttcgtttattccgattgggtggatacagaaaaagcgaaaagatatcgggattttgctgttcggcaaacggagtatatgctaggagataatccgcagcagcgaagctttgtcgttggatacggtaaaaatccgccgaaacatccgcatcaccgtacagcacacggttcatgggccaatcagatgaatgtgcctgaaaaccatcgccataccctatacggcgcattagtcggcggtccgggaagggacgattcgtaccgagatgacataacagattatgcgtcaaacgaagttgcgatcgattataatgccgcttttaccggcaacgtagcgaaaatgtttcagctgttcgggaaaggccatgttccgctgcctgattttccggagaaggaaacacctgaggacgaatattttgcagaggcatcaatcaacagctccggaaacagctatactgaaatccgggcgcagctcaataaccgttcgggatggccggcaaagaaaaccgatcaattgtctttccgctactacgttgacttgacggaagctgtagaagcgggatattccgccgaagatataaaagtcacagccggctataacgaaggggcctcggtatcagagctgaagccgcatgacgcttcaaagcacatttactatacagaagtcagcttcagcggggttttgatttatccaggcggtcaatccgcccataaaaaagaagtgcagttccgcctttcggcaccagacggaacgtctttttggaacccggaaaatgaccactcttatcagggtctgtcacatgcgcttctgaagacgcggtatattcctgtttatgatgatggacggctcgttttcggacatgagcccggttactagatattgaacttcaagaggaggaacatcatggataataaaacacgttttatgcagctgtatgagcaaattaaaaatccgaacaacggttatttctcacccgaaggaattccctatcactcggttgaaacgctcatatgtgaggcgcccgactacggtcatatgacgacatctgaagcgtacagctattggctgtggcttgaagcgatgtatggccggtacacacaggactggtcaaagctagaagccgcctgggacaatatggagaaatatattatcccggtcaatgaaggagacggaaacgaagaacagccgaccatgaactactacaacccctcaagtccagccacttatgctgcagaacacccctacccagatctgtacccttcagcgctgaccggacagtatccggcaggaaatgacccgctcgatgccgagcttaaagcgacatatggaagcaacgaaacgtatttaatgcattggctgttagatgttgacaactggtatggcttcggaaatcttctgaacccttcgcacactgccgtttatgtgaacacttaccagcggggcgaacaggaatccgtttgggaaacggttccgcatccgtctcaggataatcagacgttcggaaaaccgaatgaaggtttcatgagcctttttacaaaagaaaatcaggctccagcaccgcaatggcgctacaccaatgcaacggatgcagatgcgcgcgccgttcaggcgatgttctgggccaggcaatggggctacagcaatactaattatttagaaaaagctaaaaaaatgggggactttctccgttacggcatgtatgacaaatactttcaagagattggaagtgccgctgacggctcgccttcccgcggtgctggaaaaaatgcatgtcattatttaatggcgtggtacaccgcttggggaggcggattgggacagtatgcaaactgggcgtggcggatcggtgcgagccatgtgcatcaaggttatcaaaaccctgttgcctcttatgcactgtcaacggctgaaggcggattgattccaaattcatccacagcgcgaagcgattgggaaaaggcgctgaaaaggcagctagaactttacacatggctgctttcttcagaaggagccgttgccggcggcgccacgaacagctggaacggcaactacagcgcatatccgcagaatgtcagcacattttacgaaatggcctacacagaagcgcctgtatatcacgatcccccttctaacaattggttcgggatgcaagtctggccgctggaaagggtggcggaactgtattatattttcgcagagaaaggtgacaaatcgtctgaaaacttccacatggcaaagcatgtgattgaaaaatggatcgcatattcacttgattatgtgtttgtgggcgaacggccggttactgacgaagaaggctattatttaaatgatgcgggagaacgcgtccttggcggccaaaacccgcagatcgccgtacaatccgacccaggcgagttttggattccggcaaaccttgaatggagcggccagcctgatccgtggaagggatttgattcatttaccggaaatccgggactgcatgtcacgacgaagaatccttctcaagatgtcggcgttctcggcagctatattaaaacgctcgtcttctttgcggccggaacaaaagccgaaaccggcggctttaccgctcttggaaacaaagccaaaaatctggaaaaagaactgcttgatgcagcatggagtaaaaatgacggaatcggtatcgcagcagaggaagaacatgaagattatatccgctactttacgaaggaaatctactttccgaatggctggagcggcagaaacgggcagggcaataccatccctggccccaacactgtgccgtctgatccggcaaaaggcggtaacggcgtctatatcagtcatgcggagctccggccgaaaattaaaaatgatccgatgtggccttatttggaaaacaaatatcagacctcgtggaatccgaatacgggcaaatgggaaaacggactgccgacctttgtatatcaccgtttctggtctcaggtcgatatggcgacagcttatgctgagtatgaccgtttaatcggaaatgcataacaatcaataggagaatattagatgcgcttggccgtttgggcaaaggcggcgttcagccgccttcttttttaaaggcaggatttaggattttagcgagtgttttacacgattatctaaaaaggagatcaaaagtttgagagaaaaatggttagccttatgtttaaagtcgatcattctgttcgttttgatcatgggaaccgttcttttatccgcagttccgaaagcttcgggaacaagcgggccagcaaagcaagaaaagcagagcatcatcaccccggctgatcttttggaaaacatgagccctggatggaaccttggcaacacgctggatgctgttccgacagaaggctcttggaacaatccgccggttcgcgagcatacttttgatgatattcgcgatgcggggtttaaaagcgtccggattccggtgacatgggattcccacatcggcagcgctccagagtatccgatcgataccgattggatgaaccgggtagaagaagtgacagattgggctttggaaagagagttttacgtcgtgttaaatattcaccacgattcttggctatggatcagccggatgggaaacagccagcaggagacattagataagctggggaaagtctggaagcagattgccgagcgcttcaaaaacaaaagtgaacgcctcctgtttgaaattgtcaatgagccgaccggaatgagcgcatatcaaatgaatctgcttaaccgagagatgctgaacatcatccgttcgaccggcggcaaaaacggccagcggctcgtaatcgtcggggggcttgaagataacaaagatgaattgcttcattcatttgaaccgcctgatgatgaccggattgtcctcacatatcactactattctccttgggattacgtatcaaactggtggggccggacgacttggggatcggcagccgaaatctccgagatggaggaggatatcaaaccggtttatgaaaaatttgtaagggaaggatacccggttatcatcggtgaatacggtaccctcggcgccaatgaaaagcattcaaaatggctctatcatgatacgtttgtccgccttgcccacaaatatcaaatggtcccgatgtggtgggacaacgggaatgaccagtttgaccgggctgagagacagtggcgtgatcctgttgttaaagagattgtcattcaggcgggacgcggcgttcccaatgcgatcatcaaaccggcagatctttttatcaaaaaaggtcaaagcatcagcgatcagacggtggacattcagctgaacggcaatgtgctgactggcatttatcagaaatctgaaccattaaaggaaggcagtgattatacagttgacaatgccggaaaaacggtctctattaaggcatcctgcttggcaaagctgctgaacggggcggggcagcctggggtaaaagcgcagctcacttttacgtttcataaaggagccagccaggttatggatatcattctttatgatgacccgaagcttgaaaaaagcgaattcaccatcagtcaatcggcaatcagcggtgatctcaaaatcccggcgtcactgaacggaacgaagctggccacggttaaaggagtcgtcgattctacaggaaggccggttcttgaagaagtatggtcatggacgccctacttgaactatgacgaagatttttacgaaaaagacggggatttgtatttgaaagagcgggttttaaagtatttgaaaagcgattccacctttacatttgaactgtggccgaaaggcgtggaggcggtcgtgaaggtgaaaatcacgccttgaacggccggctatcctctcaatgacgccgtccatgcatcctctttatgaaagcagggaaaaataatgatgacgaaaaagggtttattgacagtgctgatgccgtttttgcttgcactttccgccattcagtttggcaatccccggcctgcactagccgcgtctccttttgttgagacagccggaacatcgttcactttaaatgggaaagaattttattttgccgggacgaataactattattttcattataaatctaaaaaaatggtcgatgatgtgttcgaagatatgaaagcgatgaatttgaaagtgatccgcatctggggatttcttgacggccagccgcaggaaaatacagtcatgcagccaaggccgggcatatatgatgaatcaggcttttcaaagcttgactatgccatttataaagcggggcagacagggataaaactagtcatcccttttgtgaacaactgggatgatttcggcggaatgaatcaatatgtcaggtggtttcaggcggatggacatgacgccttttatactcatccggacattaaagaggcgtataaaaattatgtatcctatatgctgaaccgagtcaacacatataatggcgtcaaatataaagatgatcccgcgattatggcgtgggagcttgccaatgaaccgagggtccagtctgacaggaccggaaatacacttgtcgaatgggcggatgagatgagcgaatttattaaatccattgatcagaaccatcttgtagcggttggagatgaaggattttatcatatagaagggcaccctgattggcattacaacggcggagagggtgtggattggaaaaggctgaccgctctgaagcatattgattacggcacatatcacctctatccggatcattggggcaaaacggccgagtgggggaatcagtggatcacagaccatatttgcgatggaaaagaaatcggcaagccggtcgttttagaagagtacggctatcaggataagtccagaagggactacgtctacagaacctggcttgaactcatagaaaagcagagcggtgcgggcagccaattttggattttgaccggcattcaggatgacgggaccctttatccggactatgacggttttcggatcgtttatccgagctctgccgcttctgtcatttcagagcacgcggagcggatgaatgaaaaatcagccgcttccgaaatgcttcagactaaacgctgtcatgatttgcaataaaaatatggttatggtatagttttattggaaatgctaacgatagccgaggcgaagagtggggaaacccgctcttttgtattgaacaggcaattttgtctcgacatgttcatcgttttttctaaaatcccctgcttttgaagcagggtttttacgagggagctgatgaatgggagcctgcacaaggaggaaaagtatgagtaacaaagtgatcgataccgtcagcgaaatggtccagcctatactagacaatcttcagcttgagctcgttgacatcgaatttgtcaaggaaggccagagctggtttcttcgcgtgtttattgattcagatgacggcgtagacatcgaggaatgtgccaaggttagcgaagctcttagtgaaaagctcgatgaggctgatccgatcaagcaaaactattttcttgaagtatcgtccccgggagctgagaggcctttaaagaaagaagccgatttcatgaaggcgctcggaaaaaacgtatatattaaaacgtacgaacctattgaaggcaataaagagtttgaaggcgagctttccgcatttgacggtgaaaacgtggaggtcacggtgatgatcaaaacgcgccggaaaacgatcaatattccatatgacaaagtagccaaagcgaggctggctgtttcgttcaattaatttttgactgtttaagggggaaaccataaacatgagtagtgagttgttagatgccctgactgttcttgaaaaagaaaagggaatcagtaaggacattattattgaagcaattgaagctgcgctcatttccgcttataagcggaacttcaaccaggcgcagaacgtcagggtagatttaaaccgcgacaccggttcaatccgcgttttcgcccgcaaagatgtcgtggatgaagtgtatgatccgcgccttgaaatctcgattgaagatgccgtaaacatcaatccgaactacattgtcggagatgtcgtggaaatcgaagtgacgccgaaagatttcggccgcatcgctgcccagacggcaaagcaggtcgtgacccagcgcgtccgcgaagcggagcgcggcgtcatctattctgaattcatcgaccgcgaggaagatatcatgacaggcatcgtccagcggatcgacaataagttcatctatgtctctttaggaaaaatcgaggcgcttctcccggttgcagaacagatgccgaatgaagtctacaagcctcatgaccggatcaaggtgttcattacaaaagtcgaaaaaacgacgaagggtccgcagatttacgtttcaagaactcatccaggtttattaaagcgtctctttgaaatcgaagtgccggaaatttacgatggaacggtcgagctcaaatccgtggcgagagaagcgggagaccgctcgaagatttccgtccgcacggataatcccgacatcgatcccgtcggcgcctgcgtcggaccgaagggtcagcgcgttcaggcgatcgtcaatgaattgaaaggcgagaaaattgatattgttcactggtcaaacgacccggttgaatttgtcgccaatgcgctgagcccttcaaaagtgctcgacgtcatcgtcaatgaagaggataaagcgacaacggttgtcgttcctgactatcagctgtcgctcgccatcggaaaaagaggtcaaaacgcccgcctggcagccaagctgacaagctggaagatcgatattaaaagcgaaacagatgcaagagagcttggaatttatccaagggagcttgaagaagaggagccggaagagcttttcttggaaagcgaaactccagaatcggatgaataagaggtgacctttggtgaaaagccgaaagaagatcccgcttagaaaatgcgtcgtaacaggggaaatgaagcctaaaaaagagctcatccgcgtcgtccgttcgaaggaaggcgaagtttccgttgacccgaccggcaagaagaacggccggggagcctaccttacacttgataaagacgtcattttaactgcaaaaaagagaaacagcttagcaaatcagcttcaagcacagattgatgatcagatttttgatgaactgctggaactggcggaaaaggagaacagataaatgtcggaatcagaatggttttccttgctgggtctggcgaatcgagctcgaaaggtcgtgtccggagaagacctggttgtgaaagaaatcaggcattcgcgcgcaaagcttgttttgcttgcagacgacgcatcggctaacacggagaaaaaagtaaccgacaaatgcaggcactacgatgtaccggtgaaaaaagtcggtgatcgtgtgcttctgggccgttcaatcggcaaagaatcccgtgtggttgttgctgtcactgatcaaggttttgcgaatacgttgctccgaaagctcgattaattttttttgggggtgaacgaatggctaaaatgagagtttatgaatatgcaaaagccataaatgtttcaagtaaggatattatcgcggcattgaaagatatgaatatcgaagtcaataaccatatggcgatgatcgaagaaaatgcgatcaaacagctcgatcaaaaattcaagaagagcgctaaacctgcgggaaataaaaaggatgccggtacaggcggacaaaagccgcagcaagaagccgcaaaactgaatgccggaagtaagccaaacaaaaatcgagacggaaagaagaataacgtgcagaatactcaatttaacaataaaaacaagaagaaaaacaacaacaacaaaaagaacaaacgcggtaaaaatcatcaatctcctcaggagaagcagttcaagccgaaaaaagaactgcctgaaaaaatcgaatttaccaactcaatgtcggtcggcgcgcttgccgaagagctcggaaaagaaccgtcagaaatcattaaaaaattaatgcttctcggcatcatggcgacgatcaaccaagatcttgacaaagataccgttgagctgatcgcttcagaatacggcgtcgaagtcgaagaagtgatcgtccatgaagaaaccgaattcgaaaaatacgaagagccggataacgaagaagacctcgaaatccgtcctcctgtcgtaacgatcatgggtcacgtcgaccacggaaaaacaacgcttctcgacagcatcagaaaaacgaaggtcgttgaaggcgaagccggaggcatcactcagcatatcggcgcttatcagatcgaggaaaacggcaagaagattaccttcctcgacactccgggccacgccgcgtttacaacgatgcgcgcacgcggtgcggaagttacggacattacgattctcgtcgtagctgcagatgacggggtcatgccgcagacggttgaagcgatcaaccatgcgaaagcggctgaagtgccgatcatcgtcgctgtcaacaaaatcgacaaaccgacggcaaaccctgaccgcgtgatgcaggagctgactgaacacggtcttgttcctgaagcatggggaggcgagacgatttttgttcctctttccgcactttcaggagagggaatcgatgagctgatcgaaatgatcctgctcgtcagcgaagtcgaggagctcaaagcaaatccgaaccgcagggcaaaaggaacggtcatcgaagccgagcttgataaaggtaaaggttctgtcgcaacgttgctcgttcaaaacggaacgcttcacgtcggagatccgatcgtcgtcgggaacactttcggacgcgttcgtgcgatggtcaatgatgtcggcagacgcgtgaaatcggcgggaccgtcaactcctgttgagatcaccgggttgaacgaagttccgaacgcaggggatcagttccttgtgttcaaagacgaaaaaacagcccgttccgtcggcgaagcgcgcgctaccaaacagcttgaagaacagcgcagcgataaagcgaagctcagccttgatgacttgtttgaacagattaaacaaggcgatgtcaaagaaattaacctcgtcgtaaaagccgatgttcaaggctctgttgaagcgctggccgcagctttgcaaaaaattgaggtcgaaggcgtcagagtcaaaatcatccacacaggcgtaggtgcgattaccgaatcagacattattttagcttctgcatcaaatgcaatcgtgatcgggtttaatgtcagacctgacggaaatgctaagagtaccgccgaagccgaaaatgtggatatccgcctccaccgcatcatttataaagtcatcgatgagatcgaagcagccatgaaaggcatgcttgatcctgagtatgaagaaaaagtgatcggcatggttgaagtccgtcaaacattcaaagtctctaaaatcggaacgattgccggaggctatgtaacggaaggtacgatcacgcgcgacagcggaatccgcttgatccgcgacggcgtcgtcatctttgaaggggaagtcgatgtgctgaaacgctttaaagatgatgtcaaagaagtttcacaaggctatgaatgtggtatcaccattaagaaatacaacgacatacgcgaaggcgatatgatcgaagcgtatgtcatgcaagaaattgaaagaaagtgatcggtttcgttgaatgcgaatgcatcatttacgatgcatcatcactcaaggaaaagcgggcggtgctgaagcggatcatcacaagaatccgcgccaagttcaacgtttctgtttcagaaattgactatcaggacacttggcagcgcacaagctttggtatcgccgccgtttcttcctctcgcgtgcaaacggaaaaagagctgcagcgggtcctcgcctttattgactcttttccggaaattgaacggacgatcacgagaacagagtggttttaacgtagaggtggtatggtcatgacgatgagagctacccgtgtgggagagcagatgaaaaaagaacttggtgacattatcggcagaaagctgaaagatccgcgaatcggatttttaacagtcaccgacgtcagggtctcaggtgatttgcaaattgccaaagtgtatatttccgttttaggcgatgaaaagaaacgggaagaaacgctcaaaggcctggcaaaagcaaagggctttattcgttccgaacttggaaaccgaatcaggcttcgcaaaacacctgaaatccattttgagttcgatgaatcgatcgattacggaaaccgtatcgaaacattgattcacgagctgaacgcaaacaaagaagaatcataagctgaaaaaggataggcgggcgactgcctgtcctttttagctccaaatgagaaaggggcgaagaagcacgaatgtataacggagtccttctattacataaaccggtcggcatgacctcgcacgactgcgtcatgaagatccgcaaactgctgaaaacaaaaaaggtcggccataccggtacactggatcccgaggtgtcgggcgttctcccgatctgcgtcgggagggcaaccaaaatcgtcgagtatttgaccgaaaagtccaaaacatatgatgcagaggtcacgcttggctgttccacggagacagaggatcagacgggggaagtcacagaaaagaaacccgtcttagcgccgcctgatgaacagaccgtgcagagcgtcctgagatctcttgaaggaacgattgagcaggttccgccgatgtattcagctgtcaaggtaggcggcaaaaagctgtatgaatacgcgcgggctggaatcgaggttgaacggccgaagcggaccatcaccatccatcatatcgaactgacatccgagatccgccatgagggggataaagcccgcttccggtttgttgtgacatgttcaaaaggcacatatgtcaggaccttggcggtaaccatcggggagaagctcggatatcccgcgcatatgtccaatctggtcaggaccgcgtcaggccctttcacccttgacgaatgcttgacctttgaagacgtcgaaggcttgatcgctgacggaacattgtctgaaaagctcgtccccatcgaacgtgcgcttgatcatttgccgaaatggataattagtgatacattagctaagaaagtggaaaatggagcggtgcttgaaacgcccggcagcttttctcatttgacgagcgaagaccgcattgcggtctttacggaagcaggccggtgcacagccgtctattatccgcatccgaccaaaaccggtttgttgaagccggcaaaagtactcgtgcaaaaaagcgaacaatagaaaaggtgaccgttcttgaagacgatacatatttcccacccacacgacttgaagcgtgaggattttccgacatcagttatggcattaggttattttgacggtgttcacctgggacatcagcaagtgattcttacagcaaaaaacaccgcggcaagagaaggggtcaaaacgtccgtgatgacctttcatccccacccttctgccgtgctcaaaaaaggccgggagccgaaggatttaatcacgcctttgcaagacaaaatcagcatcattgaagatttaggggtcgattttttatacgttgtcacatttacccctgaattcgcttctctatcacctgaggaatttatcgatcaatatatactcggctttcatgtcactcatgttgtagccggatttgactttaccttcgggaaattcggcaaaggcactatggaaaacttccaggagtatgcgaaaggccgtgttaaaagcacgtctgtcgcaaaatattccaatcaggatcaaaaggtaagctccacgaggatccgcagcgttctgggagccggtgacgtcgagtacgctgctgaactgctcggcaggccgtaccatgtgaaaggctttgtgatccacggcgataaaagaggccgcacgatcggatttccgaccgcgaatatcggccttaaagacacatacatcgtcccgccgacaggtgtgtacgccgttaaagccgaaatcggcggcgctgtctacaacggcgtctgcaatgtcggatacaagccgacgttttacgaaaaacggccgggtcagccttcaatcgaagtcaacttattcgattttgaccgtgacatatacggctccgaaatcaaggttgaatggtataagcggctgaggagcgaaaaaaaattcggcagcgttgacgagcttgtcgaacagatttctagagacaaagaagaagcgatccgcttcttcagagagcggaagccggccggaatctagatgtatggaaacggcaatacgcgtcaacaatggtgataaaaaggtaaacttcatcataaatggttgcattagacccgaacttttagtatcatattgtctgtagctttaaaaccgttcacttggcaaatcgaatcaccggcgtttgctaggtaatcggggctaatattatatggaggtgaaacaggatggcaattactcaagagcgtaaaacacaactcatcaatgagttcaaaacccacgaatctgacacgggatcaccggaagttcagatcgctatcctaacagatcaaatcaacaacttgaacgagcatttacgcactcacaagaaagaccatcactcacgtcgcggtcttcttaaaatggtaggtaaacgtcgtaatcttcttacgtatcttcgtaacaaagacgtaactcgttaccgtgagttgatcaacaaacttggattacgtcgataatcgtaaaaagcgggaggattcccgcttttttatcgtataagaacgaatatccggcaactctaaaacgcgttgttcatataaatgattttaaatgacaccgattcattctttacatagcactttgccattgatatgttcaattcatttcgttcataataggagtaacctaaaaactatccgaagagaggagttcatataagaatgggacaagagaaacatgtcttttccatagattgggccggccgcaagctcacagtagaaaccggccagcttgcaaaacaagcaaacggagctgtcatggtgcgttatggagacactgcagtgctcagcaccgcaacggcttcaaaagaacctaaaaccgtagactttttcccgttaaccgtaaattacgaagaaagactttacgccgtcggaaagattccgggcgggtttattaaaagagagggaagaccgagcgaaaaagcgattctcgccagccggttaatcgacaggccgatccgcccgctgttcgcagacggcttccggaatgaagttcaagtcgtcagcatcgtcatgagcgttgaccaggattgttcgtcagaaatggcggcaatgtttggatcatctcttgcgctgtgcgtatccgacatcccgtttgaagggccgatcgccggagtgacggtaggccgggttgacaacaaattcatcatcaatccgacacttgaacagcttgaaaaaagcgacattcatctcgtcgtagcgggaacgaaggacgcgatcaacatggttgaagcgggagcagacgaagttccggaagagatcatgcttgaagcgatcatgttcggtcacgaggagatcaaacggctgattgccttccaggaggaaatcgtcgccgctgtcgggaaagaaaaatcagaaatcaccctgtatgagatcgattccgatctgaaagaaaaagtgcggggaatggccgaatcgaacctcttaaaagccattcaggttcatgaaaagcatgcgcgcgaggacgcgatcagcgaagtgaaaaacgaggttttggccaagtttgaagaagaggaacacgatgaagaaacgctgaaacaagtgaaagacattttgtcccagcttgttaaaaatgaagtgcgccgtctgattacggaggaaaaagttcgtcctgacggcagggctgtcgatgagatccgcccgctttcttcagaagtcggactgcttccgagaacacacggttcaggactttttacaaggggacagactcaggcgctcagcatttgtacgctcggtgcgcttggcgatgtgcagattttagacggtctcggcgtcgaagaatccaaacgctttatgcaccattacaacttcccgcagttcagcgtcggggaaacagggccgatgcgcgggccgggacgccgcgaaatcgggcacggagccctcggggaacgagcgcttgagccgattgttccgtctgaaaaagacttcccgtacaccatccgcctcgtctctgaagtgcttgaatcaaacggttccacttcccaggcgagcatttgtgcaagcacgctagcgatgatggatgcaggggtgccgattaaagccccggttgccggaatcgcgatgggtcttgtcaaatcaggtgacaactataccgtcttaaccgatattcaaggtatggaagaccatctcggggatatggactttaaagtggcgggaacgtccaaaggcgtcacagctctgcaaatggatattaagatcgaaggcttatcgagagagattttggaagaggctcttcagcaggcgaaaaaaggcagaatggagatccttgaaagcatgctgagcacattggctgaatcaagaaaagagctttctccttatgcgccgaaaatcttgacgatgtcgatcaatccggataaaatccgcgacgtcatcggaccaagcggaaaacaaatcaataagatcattgaagatacaggcgttaaaatcgatattgaacaagacggcacaatcttcatttcttctaccgatgaaagcatgaaccaaaaagcgaagaaaatcatcgaagaccttgtcagagaagttgaagtcggacagctttacttaggtaaagtgaagcggattgaaaaattcggagctttcgttgaactgttcagcggaaaagacggtcttgtccatatttcagagcttgcgctcgaacgggtaggaaaagtcgaagatgtcgtcaaaatcggcgacgagctccttgtaaaggttactgaaatcgataaacaaggacgcgtcaacttatcaagaaaagctgtactgcgtgaacagaaggaaaaagaagaacaaaaatcgtaaaaaaaacggtgtctatcttgcttctgtcttcgtcttcaagcaacaggaagcctgggtaacccggcttctttgttttaagccgtgaaaacggtccggttctatcttgtccttttctcacatattttgtggggaagggaggaatacaattgaaaggaacgattgttcggatttccgtttttttctttcttttgctgatgtcctatcagatgatgaaccgtccgtattcacaacattacatagatgcgatgaaaaaagacgcggtcacggttgccgctcaaaaggacgatttgtaccaggagcttttgcaaaaagcgcctgaatatgaagtgaaggcccagaatgcgaaaattgatcacatatggaaagcgatgcccggctacaacggcttaaaagtaaacatcgaaaaatcgtacaaaaaaatgaaacaggccggtgaatttgatgagaaactgctcgtttatgaccaagtgaagcctgacgttcatttagaatccttaaagcctgagccgatctaccgcggacacccggataaaccgatggtatcgtttattatcaatgtcgcttggggtaatgaatatttagaagagatgcttcccgtcttacaacagcatcgtatcaaagccaccttttttctggagggcagatgggtgaagcatcaccccgagctggccaaagccatacaaaacggcgggcatgaaatcggaaaccattcatacaatcatccggatatgagcaaactgacgagagaacgtatttcagaacagctgcggatgacaaatgaacaaatacaggaaacgcttggcgtcaagccgaagtggttcgccccgccgagcggcagcttccgcaaagaggttgtggatcaggctcacaagatggggatgggaacgatcatgtggacagttgatacgatcgattggcagaaaccgcagccggccgtcttacagcaacgggtattaagcaaagtacataacggcgccatgatattaatgcatccgacagatccaactgcaaaaagtcttgccgttttgatacagaacctgcatgaaaaaggctatcaaatcggaactgtttcacagctgatgaatgaaaaaaggcttgttgaagaataggatgtgcggcccgttctttgaataggaggaacaaatttgattaaacggtatacttgtcaaaatggggtaagaatcgtattcgaaaacaatcccaccgtccggtctgtggccatcggagtttggattggaaccggatcaagacatgaaacacccgaaattaacggcatttcgcactttcttgagcacatgtttttcaaggggacaaaaacgcgcactgcaagggacatcgcagagtctttcgatagaatcggcggacaggtcaacgcgtttacctcaaaggaatatacgtgctattacgccaaagtgctcgatgagcatgcaagctatgctctggaagtgctttctgacatgttctttcattcatcatttgacgaagaagaattaaaaaaagaaaaaaacgtcgtctatgaagagattaaaatgtatgaggacacacctgatgacatcgtccacgatctcttgagcaaggcgtcatacggcagccattccctcggctatccgatcctcggcacagaggaaacacttgccgaatttgacggagattcgctcagaaaatatatgaacgaatattacacgcctgaccgagtcgtcatttccatagccggaaatgtgccggaaacttttataaaagaagctgaaaagcatttcggttcatatgaagccaaaggcaaaagaaccggcatgacaaaaccggattttcaccatgagaaaatgacgcgcaaaaaggaaaccgaacaggctcacctctgcctcggcttcaacgggctggaagcaggccatccggaaatctacgatttgatcgttctcaataatattttgggaggaagcatgagcagccgcctctttcaggatgtccgcgaagataaaggtcttgcatattccgtgttcagctaccacacttcctatgaagacagcggcatgatgaccatctacgcgggaaccggcgcaaatcagcttcagctcctgtcagaaacgattcatgaaacactgcgtgcgctgaaaagcgacggtattacaccgaaagagcttgaaaacagcaaagagcaaatgaaaggcagcctgatgctcagtctcgaaagcacaaacagcaaaatgagccgcaacggcaaaaatgagcttttgctcggtaaacaccggacgcttgatgaaatcatcgaaaagttgaatgccgtcagcctcgagcgtgtgaacaatcttgccaaccggattttcaccgatgattactcatctgcattaatcagcccgtcgggtgagctgccgaaataatgcctccttaaaacatgcttgtctttttaggcaggcatgttttttgttatcggttcatacatcataacaaaagggggtttttttcatgaggctgagtgaactttcgggaaaagaaatcgttgatgttaagcgggccgaacggctcggcgtactggggcagacggaccttgagatcaatgagcaggacggtcagattaccgctcttatcatcccttctgttaaatggttcggactaggaagaaaacaggggaatgacattaaggtgccctggtcgcaaattcaaaaaatcggctcggatatgatcattttggatgttccggaaagcagcgtgacaaaagaggagtaagcaaggtggaaacccgcccgtcccatgggggcgggctttttgtttttctggatttcaattcaccgctatttcctttttgtcatatgatgaaattagcttatgaattagatccttgtcaaaaaagaaggtgaatgttagagccatgttaaccggattgacgattgcaatcatcggcggcgatgcaaggcagctcgagatcatccgcaagctgacggaacaggatgcaaaggtctttttaatcggttttgatcagcttgatcacgggtttaccggagctacaaaactaaagctgaacgaacttgattttggcacaatagacagcattattctgcctgtatcgggcacatcgatggaaggaacggttgcgactgttttttccaatgaaaaagtggtgttaaaacaggaacatttagaaaaaaccaagccgcactgcgcgatttattcagggatttcaaaccaatatttagacggcatggccaaaggggcgaaccgtcgtcttatcaagctctttgaaagagacgatattgcgatttacaactcgatacctacagtcgaaggtgccattatgatggccatacagcatacagactttacgattcacggctcgaatgtaatggttctcgggctggggcggacgggaatgagcatcagccggacgttctcggcgctcggcgcacgcgtaaaagtcggagctcgcgactccgcccacctcgccagaatcatggagatgggcctcactcctttccacacaaacgaacttgcagagcatgttgaaaatatcgacatatgcatcaataccattccaagcctgattctcgataaacatgtcctctcacgaatgacacccagaacattaattctcgatttagcaacccgtcccggaggcacagattttgattttgccgaaaagcaaggcattaaagcgctgcttgctccaggacttcccgggatcgtcgcgcctaaaacggcgggacagatcattgccaatgttttgtgcaaccttttgtctgaattaacaactgaccgaaaggggctgtcataatgtcgatcaaaggaaaaagaatcggatttggcctaacgggttcacattgtacgtatgatgccgtttttccgcagattgaagcgctgatcaacaaaggggctgaagtcagaccggtcgtgacgcatactgtcaagtcgacggatacacgctttggagaaggggaagaatgggtcagaagaatagaagagctgactggatttgaagtcattgattccattccgaaagctgagcctctcgggccgaaaacaccgctggactgcatggttgttgcgccattgacgggaaattcgatgagcaagcttgcaaacgcccagacggacagtccggttctcatggcggccaaagcgacgatgagaaactcccgtcccgtcgtcctcggcatttcaacgaatgacgcgctcggcttgaacggcgtcaacttgatgaggctgatggcggcaaaaaatgtttactttattccgttcggccaggatgacccttacaaaaagccgaattcgctcgtcgccaaaatggatcttttagtgccggcggtcgaagaagcgctctcccataaacaaatacagcctatcctggtccataatgatcaataaatcttttgaaaataaagatgtaacaaaaaatatcaatcaccacggcacacatctatgttaaaataaaatgtaaaatgcatagtcaaccaatcgtttacgacgattaaggtggaaggagttttacaattgggcagaggattacatgtagcagtagttggtgcgacaggcgctgtaggacagcaaatgttaaaaacactagaagacaggaattttgaactggataaactgactttattatcctcaaaacgttcagcaggtacgaaactgactttcaaaggcgaagagtacacagtagaagaagctcgtcctgagagctttgaaggcgtcaacatcgcgcttttcagcgccgggggaagcgtttcgcaggcgcttgctcacgaggctgtcaaacgcggggcgatcgtcattgataatacgagcgcgttccggatggaccaaaacactccgctcgtcgtacctgaggtcaatgaggaagatttgcacaagcacaacgggattattgcaaatccgaactgttcaaccatccagatggttgttgcgctcgaaccgatccgcaaggctttcggtttaaacaaaatcatcgtatcgacttatcaggcggtgtctggagccggaaacgaagctgtaaaagagctctacgggcaaaccgaagccattttgaacgacaaaccgttcgagcctgagatcatgccggtgaagagtgatgaaaaacactaccaaatcgcatttaacgctattcctcaaatcgataaattccaggaaaacggctttacgtttgaggaaatgaaaatgataaatgaaacgaaaaaaatcatgcacatgcctgagcttcaagtttcagccacatgtgtcagactgccgattgcaacagggcattcagaatccgtctacatcgaaacagaccgtgatgatgtgacagcagaggatattaaaaatctgttaaaagaagctccaggcgtcgttctgcaggatgatccagctaaacaggtctatccgatgcctgcagatgcagtagggaaaagagacgtatttgtcggccgggtgagaaaagaccttgaccgcccgaacggtttccatctgtggatcgtttccgacaacctgctgaaaggcgcggcatggaattccgtacaaatcgcagaaagcctaaaagctttaaatttagtttaagatttctaacgggatgtgagaagagagtgaggcaaaaatgaaggcctgctctcttctgttacgtccgaaatcaacttggagtgaaataaagtgaaaatcatcgttcaaaaattcggcggaacgtctgtaaaagatgaccgcggcagaaagcttgccttaaaccatattaaggaagcggtcaatgaaggatacaaagcggttgtcgtcgtatcggccatgggccggaaaggcgatccgtatgcgactgattcattgcttgatctgctttacggcggacaggatacaattaccgagcgtgagcaggatatgcttttatcatgcggggaaacgatttcctctgttgtgttcgccagcatgcttttggaaaacgggattaaagctgctgctttaaccggtgcgcaagcgggctttttaacagacaacaaccatacgaatgcaaagattctcgaaatgaagccggagcggcttgtcagcatgctggccgaccatgatgcggtcgtcgtcgcaggcttccaaggcgcgactgcaaaaggggatatcacaacgatcggccgcggcggaagcgatacatcggccgctgcgcttggcgcggctctggacgcggaatttatcgatatttatacagatgtcgaaggcgtcatgacagctgatccgcgcatcgttgaaaaagcgaagccgctgcctgtgattacctatacggaaatctgtaatttagcctatcagggggccaaggtgatccacccgagagccgttgaaatcgcaatgcaggcgaaagtgccgatccgcgtgcgttcaacctattcaaacgaaaccggtacgctcgtcacaagccatcacaactcgaaagccggaagcgacgtttttgagcagctcatcacaggcatcgcccatgtgaaagacgtgacacagtttaaagtcccggcaaaagaaggacaatataacgtacagactgaagtgtttaaagcgatggcgaatgcgggcatcagcgtcgatttcttcaatattacaccaagtgaaattgtctacacggtggctggaaacatgacagaccgcgcccacagcatcctgaaggaattgggctatgaaccggccgtgacgagaaattgcgcgaaagtgtcagcggttggcgcggggattatgggcgttccaggcgtcacctcaaaaatcgttaccgctttgtcagaaaaaggcattccgatcctgcagtctgctgacagccatacgacgatatgggtgctcgtgcacgagaaaaatatggcgacggccgtaaatgcgctgcatgaagtgtttgaactgtcaaaataaatatgattgaatcatgatgaggtgaaaaaaatgaatttcggaaatatcgcaaccgcgatggttacgccctttgacaaaaatgaaaatatcgattttcaaaaactgtcaaagctgatcgattatttactaaacaatgggacggattccctggtcgttgccggaacaaccggagaatcgccgacgctttccgaagaagaaaaggtagcgctcattcaatactctgtcaaggaagcggcaggccgtgccccaatcatcgccggcacgggaagcaacaacacgaaggcgtcgatcaagctgacgaaaaaagctgaagaagccggcgctgacgctgtcatgctcgtcactccgtactacaacaagccttctcaggaaggcatgtaccgccatttcagagcgattgcggaggaaacatcgctgcctgtcatgctttataatgtgccgggaagaacggctgcttcgctcgcaccagagacgacaatccgccttgcggagatcccgaatattatcgccattaaagaagcgagcggcgacctagatgcgataacaaaaatcgtagccgaaacccctgaggactttgcagtttattcaggagatgacagcctgacactgccggcgctgtccgtgggagcgagaggaatcgtttccgttgcatcacacatcatcggaccggaaatgcaggaaatgatcaaacattataccgaggggaacacggctcaggctgctttgatccatcaaaagctgcttccgctgatgaaagggctttttgccgcaccgaacccgtctccattaaagacggctcttcagctgaagggtcttgacgtcgggtccgtccggctccctttgattccgctaaatgaagatgaacgactccgtttaagcagcctgatgaacggcctgtaaaaaacaatacggacgaaaacggtcattctcttttggaggggatgaccgtttgtcatatacataatggttcttgttttctaaatttagattcaggtataatagggacaagtgatgatggacgggtacttagattaggaggattacaatttgaaaaaaaatacagaaaatattagaatcatcgccttaggaggcgtcggagagatcggaaaaaacctctatgtcattgaaatcgattcagacatattcgtggttgacgccggcctcatgcatccagaaaatgaaatgctgggtatcgatgtggtcatccctgacatttcttatttaattgaacgatctgaccgcgtaaaggcgatttttctcacacacgggcatgaagaaaacatcggcggcgtattttactgcctgaacaagctttctgtgcctgtttacggaacgaagctgacgcttgcccttttaaaggaaacgctgaagcagtacggtgtaaacaaaaagcccgatttaagagaaattcattcaaaatccgttattacatttgaatcgacaaaggtgtcattcttcaaaacaaatcacagcatcccggattccgtcggtgtcagctttaaaacatccctcggatccatcgtgtgcacaggcgattttaaatttgaccagacacctgtgttaaaccagacaagcgacatcggcgaaattgccaaaatcggcaacagcggtgtgctgtgcctgctttccgacagcgccaatgccgagaagccgggctatacgccttcagaagcactcgttggcggagagatatccgatgtgatgtacaacgccgaaaaccgcgtgattattgccgtgttcgcgtctaactttaaccggattcagcaggtgattgatgccgcgctgcaaaacggcaggaagcttgcagtttcagggaaaaatatttcggcgatactccagctggcgatgaaactcgggtatgtcacggcagatgaagatatgttcatccctgtccaagaagtcaaaaagtatccaaaaagagaagtcgcgattttgacaggggacaaccatggagagccgctcgccgcattgaccaggatcgcaaaacaagggcataagcagcttgacattgaggaaggggataccgtcctgatcgcatcctcccctatcccgggtcaggagcttgtttactccaaagcggtcgatctcttaacgagagcgggcgcccaggtcgtattcgcacaaaaacgcgtccatgtatcaggccatggctgtcaagaagagctgaagctgatgctcaacttgctgaagccgaagtatttaatccccgtaaacggtgaatacagaatgcaaaaagcgcattccaagcttgccgaagaaatcggcatgaaacggagcgacattttcctgattgaaaaaggagatgtcgtggaattccgcggacaaaacgttaaaatcggcgataaagtacactcaggcaatatattgatcgacggactcggcgtcggcgatatcggcaacatcgtgctcagagaccgccgtctgctatcccaggacggaatcttaattgttgtgattacccttgataaaaagaaaaaacatctagtttcaggacccgaaattatcacgagaggttttgtctatgtcagagaatctgaacagctgatcgttgaagcgacagagcttgtcagggaactcgtcaacgaaagcacagaaaacgccgtcgtcgaatggtccgccttaaaacagacgatgcgtgaggcattaaaccagttcctatacgaaaaaacgaaacgaaaaccaatgatcattccaatcatcatggaagtataaaaaaccaagagactcctcttggttttttttcatgccttttgcgttgaatgaaaaaaacgccattgtccataatacaaaagaaactcgagaaagaggtgagccagatggattcaaaccggatacaaaacggggacagccaaggggagcagccggctaagcaggacgcaaaagacagtctcgtcaacaaaatccagcagctcggcgaaacgacactcccgcagatggggcaggacaccaacattcactgcctgaccattatcggacaaattgaaggtcacgtccagcttcctccccaaaacaaaacaacaaagtatgaacatgtgattccccagatcgttgcagtagagcagaatcctaaaatcgaaggtctgctcatcatcttaaacacggtcggaggagacgtagaagcgggccttgcgattgcggaaatgctggcgtccctgtcaaagccgacggtctctatcgtactgggcggcggacattcaatcggagttccaatcgcagtgtcctgcgaccacagctatatcgctgaaacagctacgatgacgatccatccggtcaggctgacagggcttgtcatcggtgtgccgcagacatttgagtatctcgacaaaatgcaggaaagggtcatcaatttcgtgacaagccattccaacatatcggaagaaaaatttaaagaactgatgttttcaaaaggcaatttaacccgtgacatcgggacgaatgtcgtaggaaacgatgcggttaaatacggattaatcgatgaaaccggcggagtcggacaggcgattcaaaagctgaatgaattaatcgaacaaaacaagggcgcccaggaagggatgatccaatgattctgtatacgacaatgccgcaggaaatcgtgttcgcagggcaggcggaaaactcgaacttaaaacagatcgatgtaaacggcgtgccccttttagtcgagatgaacggagaggaagcaagggtcgttcaggttctcagcacgaacccgatggattttttaaaacaagaaacggcccctgggcagacgcttaaactgacattttataaatagctggagtgtctcaaggataaatatgctataataggggaatccagaggaaaatcgcagccgaaaaaaggctgctttctctttgtttttacattttttaacacgcagtaaggtgatggaacatggcaaaaagaaaacgaaaatcaacaaagaaacaaaaacaaggaaaaaaacggatccatcttaaatttgaattgtacggattaatctgtatcgccatctcgattattgcggttttgcagcttggcgtagcagggcaaacgttcatttacatgttccgctttttcgccggtgaatggttcatcctttgccttctcggcctctttttaacgggcttgtctttattttggaaaaagaaaacacccagttttttgacgaggagaaaagcgggcctttactgcatcattgcaagcatgctgcttctttcacatgtccagctgtttcagcatttgaccgaaaggggaatggttcagtctccgagcgtgatccaaaatacgtgggagctgtttctgatggatgtaaaaggcgagacaggatcgcctgatcttggaggcggaatgattggagcccttttattcgcggcgtcatattttctgtttgcatctgcaggatctaaaatcatcgccgtcttcctgatcttgatcggccttcttttgattacggatcggtcgcttcaggagacgctgatcaaatggatgaccccggtcgcctccttcatgaaaaaccagtggcaggcctttttagcagatcttaaacaattgaaaaacagctcgccgaaaaagaaatccggaaaaaaacaaaagacgcagagaaaaccgaaagtgtctgaagagcctgtacaagaagcggaccttgatccagatccggttattcaatcagaaccgattatttcaagcttttccgaccgtgatgaaaagcccgaagttcaagcttacgaagctccggcggctcctgctgaacctcctgctgagcccgaaatcggtgaggaaatgcaggcctccggcgcgcccgaaatcacgtttacagagctagaaaacaaggattaccagcttccgtcgattcaattgctggatgatccgaagcacacagggcagcaggcggataaaaagaatatttacgacaatgccaggaagctggaaaggacgtttcaaagcttcggagttaaggcgaaagtcacccaggttcatctcggcccggccgtcacgaaatatgaagtctatcctgatgtgggcgtcaaagtcagcaaaattgtcaacttaagtgacgacttggctttagcgctcgcggccaaggatatccgcatcgaagccccgatccccggaaaatcggcgattggaatcgaagtgccgaatgcggaagtggcgatggtttccttgaaagaagtgcttgaatcgaaactgaatgaccggccggatgcaaagctgatgatcggcctcggccggaacatttccggagaagcggtattggcagagctgaacaaaatgccccaccttcttgttgcaggagcgaccggaagcgggaaaagcgtctgtgtcaacgggatcattacaagcattttgatgagggcaaagccccacgaagtgaagatgatgatgattgatccgaaaatggtcgagctcaatgtctacaacgggattccgcatttgctcgctcccgtcgtgacagacccgaaaaaagcatcgcaggctttgaagaaagtcgtcaacgaaatggagcggcgctacgaattgttttctcacacgggaacgagaaatatcgaagggtataacgactatattaaacggatgaatgccgcagaagaagcaaagcagccggagcttccatacatcattgtgattgtggacgagcttgccgacctgatgatggtcgcttcctctgatgttgaagactcgatcacaaggctttcgcaaatggccagggcggcgggcatccacctgatcattgcgacgcagaggccttcggtcgatgttatcacaggggtcattaaagccaacattccgtcaaggatcgctttcagcgtatcgtctcagaccgactccaggacgattcttgatatgggaggcgctgaaaaacttctcggcagaggggacatgctgtttctccctgtcggcgccaataaaccgctccgcgttcaaggtgcctttctgtcagacgaagaagttgaaaaagttgtcgatcacgtcatcagccagcaaaaagcccaataccaagaagaaatgattccagaagagacgcaggaaacggtcagcgaagtgacagacgacctttatgacgaagcggtcgcacttgtggtcagcatgcagacggcttctgtatccatgctgcaaaggagattccgcatcggctatacaagagcggcgcggcttatcgatgccatggaagagcggggaatcgtcggcccatatgaaggatcaaaaccccgtgaagttctcttgtcaaaagagcaatacgaagaactctcttcttgagaagagagttcttgtttaacataatttcattatgtaaactaaaaaacatctatttatttatttgacaaaacatgatatagttatcctcaattaaagataatttgaatctgatctgtcagacggagggaaaacatgtcgataaaagctgacaatcaacggttatgtttaaaggtgattgatcggataaaagatgatattcaaaatggggtcttttgcgaaaatgaacggctcccgagtgaatttgagctgtcaaagatgcttggtgtgagcagaacggctttgcgtgaggcgcttagaatactggaagaagaaaacgtcatcatcagaaggcatggagtcggacattttgtaaatgccagaccgttatttctatcaggtattgagcagctgaacagcgtcacaaaaatgatcgagcaggcaagcatgacgccgggaaccatttttatgtcctcacaggttaccgctcccactgaagaagatatgctccggtttcaatatgcggaagaaaccgagatctttttgcttgagcgggtgagaacggcaaatggaatgccggttgtctactgtcttgataaaatacctgtggacattctcccggaaggcttttcacacgagcaggaatcgatgtttgaatggcttgagaacaaatccggcgccgtgatcagctacgctgttgccgatattgtgccaatcggatatcatgacaccatttcccaaattcttgaatgcgatcctgaaacgtctttgctgctgctcaaacagactcattatgaccaaaacgataagcccgttttatattctttaaactattttagggccgataaattcagatttcatgtcgtcagaaaacgtttttgatatgcgggcgctctattaggagcgtgttttttttgcccgcttgagcgcctatacataaataagcccgcatcatggaacaataacagatggaaatactgatgaattgggtgaaaaaagttgagcagaaaaaaagacatgaaaagcatttttgcgctgtcttcggtcccgctcgtgatgacgctcggcaattcgatgctgattccggttttgccggtgatcgaaaaaaaattaaacatttcttcgtttcaggtgtcgttgatcatcacggtttattcaattgtggcgattgtatgcatcccgattaccggctatatgtcggaccggttcggaagaaaaaagatcatgctcccatgccttctgattgcgggagctggaggagcgttagcaggtttggcttcaacttttttcaatgatccgtttgcgatgattttagcaggtcgcgtccttcaaggaatcggctcagccggcgcagcgccgatcgtcatgccgtttatcggcgacttgttccaaaatgatgaagaaatcagcgcgggactcggagatatagagacggcaaatactgccggcaaagtattaagcccgatattaggggcttttttagcatcttgggtttggtacatgccgttttggtttatcccggtcgtgtctcttgccagcttttttctcgtcttgttttttgttcccaaaccgaaggacaaagatgatgaaaagcaaacgttaaaaaactttgcaaaaagcgtacaggaaattttcaaacgggaaggtcggtggcttgtttccacttttgtcatcggcggaattattatgtttcttttattcggagtgctcttctacctgtcggatactttggagaagaagcatcaaattgacgggattgcgaaaggagcgcttctcagcattccgctgctttttctttccgtcagttcctaccttgccggaaagctgatcggaaacgataagatcagaatgaggatctgcgtgctgatcggcatgatcctgctggctttgtcgtttgccggtttgtggtggaaccacagcttttacccgttatttttgtttatgtccatcggcggcatcggcatcggaattgcgctcccttctttggatgcgctgattaccgagggaattgaaaaagaagagcgcggcacgatatcttcgttttacaacagcatgaggtttatcggtgttgcgctcggaccgccggttttcgcctatatgatgacaaatgcggggtggctgattttcatcgtatcgcttttgtgcagtttagctgcactagcgcttgtgctgtttaatattgacccgaaagaagacgaaagtgaagcggcaaagacggtgtagatctgcaccgtctttttcataaggttttttagtttccttaaatctcctccagttgatataattacaaccatacagtccaagcgcatatgctgaaatgtggtcataatacataatataaacaaggacgatggaggttctagtatgacataccttaacgaaataaaaggaaagcaccgcggattgacaagccacattgtcaaaacggaaaaattcaaaaccgtctcgattatttttaaaatgcttgctcctttaacaaaagaggatgtgacaaagagggcgctttttccgcatgtgcttttgcggggaacgagcacccgccccaaaacggccgaactcagatcgtatcttgatgaactttacggcacttccgtatcatgcgatctctccaaaaaaggggaaatgcatgtcatcacattcaggctcgatatcgctaacgaaaaatttttaaaggatcagacaccgcttctggaaaaagggcttgagcttttgtcagagatcattttttcgccggcgcttgaagacggggcctttctgccgctgtacgtgtctcaggaaaaacgcacactaaagcaaagaatacaggcggtctataacgacaaaatgcgctattcaaatttgaggctgattcaggagatgtgcaaagatgagccatacgcgcttcacgtcaacggagagcttgatgatgtggacggcatcacgcctcaaagcctgtatgaagcttatcaaaaagcggtcagcgaagaccagctcgacatttacgtcgttggggatgtggatgagcagcaggtggattcgtacatttccaaatactttgaagcaaacgagcgggagctgagacctgttcccgagcttgagcaaacccgcacaagggagcctcaggaagtcatcgaggatgctgatgtcaagcaagggaagctgaacatgggatttcggacgggaacgcattttacggatgacgattatacggcgcttcagctgtttaacggcttgtttggcggattttcacattccaagctgtttattaatgtcagggaaaaggccagccttgcctattatgcggcttccagaatcgaaagctttaaagggctgttgatggtgatgtcggggattgaagtcggcaattatcaaaaagccgtcgacatcatcaaggagcagtttcaggaaatgaaaaaaggcagctttacagaagaggcaatcgaccagacgaaagccgtcattaaaaaccagattcttgaaacgcttgatacaccgtacggtttagtcgaatttatttatcagcaggctgccgcccaaaccgaattttccttggaagactggctgggacgaatcgacaatgtcacaaaagaagacatcatcgaagtcggaaagaaaatcgatttggatacaacgtactttctcaaagggacggagggagcatcttgacgaaaacgatcgaatttgaacagctgaaggaaacactatattacgaaaaaatgcctggcggcctcgatgtctatgttcttccgaaagaaggatttaacaagacatatgcggtctttaccacaaaatacgggtcgattgacaatcagtttgtcccgctcggaaaagatgaaatggtccgcgtgcctgatggaatcgcacactttctcgaacataagctctttgaaaaagaagacggcgacgtttttcagcaattcagcaggcagggagcttcggcaaatgcgtttacctccttcacaagaacggcctacctgttttcaagcacgtcaaatgtggaagaaaacctggaaacgctcgtcgactttgtgcaggacccttactttacagaaaaaacggttgagaaggaaaaaggcatcatcggacaggaaatcaacatgtatgacgacaaccccgactggcgcctgtttttcggcctgatcgaaaacatgtatcaagagcaccctgtccggatcgatatcgcaggcacgatcgaaagcatctctcatattacaaaagaccttttgtacgaatgctatgagacgttctatcatccgagcaatatgctgctgtttgtcgtcggtccggtcgatcccgaagcgatcattcgccaggtccgcgaaaaccagcagaaaaaaccgtatacagaccagcctgaaatcgtccggaaagaagttaaagagcctggggccgtatttaaaaaagaacaggaaattaaaatgaatgttcaaagctcaaaatgcctcgtcggtttaaaaagcgctcatccgatgaatacgggagaagccctgctgaagcatgagctgaccatcaacctcatcctcgagtgtctgtttggcaaaagctcaagcgattacgaaagaatttatgaaaaagggtatatcgatgagacattcagctatgactatactgaagaacacggatttggcttcgtctctgtcggcggagatacgcctgagcctgacaagctggccgaagagctcaaacaagtgctgttcaaagcgaaagaaacgatcacagccgaaaagctggaactggccagaaagaaaaaaatcggcaatttcctgaaatcgatgaattcgcctgagtacatcgccaaccagtttacacggtacgcttttctggagacgagtctgtttgatatcgtcaccgtactcgaatcgattacgcttgatgacgttcaccgcgtcattgaggaagaagttgaggaagacaggatcaccgtctgcaaagtcgttccaaaatcataaagcaaggtctgaaagttcagcgtgcagggatatttccgatgcacgctgaacctttcttcttttttaacggaaaggtggaaatatggtatgacaaaactcgctctcatcaccggcgcaagcggcggaatcgggcaaagcatcagcgaaaagcttgcgcaaaacgggtatgatcttctcctccattatcatacaaatgagaaggcggccgcttcacttgcagaaaggctgtcacatacatacggcattcacgctgaaatcattcacggcgacctgtccgaccccggaggtgcaaaagccgtttccgcttccatcggcggacgggcgctagacggcatcgtcttgaacagcggacaaagcttccgcgggcttgtgacagatatgaccgatgaagctgtacaggacatggtgcagctccatgtctcaagcccgtttctattaacgaggaatctgcttccggcgatgatcaggaaaaagtccggcgctattgtagccgtcagctctatttggggtgagacaggggcgtcgtgcgaagttttatacagcatgacaaaaggcgcgcaaaatgtgtttgtcaaagcccttgcaaaagagcttgcgccgagcggcatcagagtcaacgctgtttctccgggcgctgtaaaaacaaagatgatgagctcattttcaaaagaggaagaagagatgatcgccgatgagattccgatgggaaggctcgccgaagccgaagaggttgcagacgccgtcttgtttctgctctcggcgaaagcatcttatatcacgggtcaaattttgtcagttaatggcggctggcattgttaaaaacatgtatagtttacgattcccaagagaataataaggctgtaacttcaagagaatggaggggcctgatatgtccgtactggataattgggatcagtggaaaaactttttgggcgaccgtttgaactatgcccaagaacaaggaatgtcaaaagaaaccatctcagatcttgcatatgagatcggcgattatttggccggtgaggttgattcaaaaaaccatcaagaacgagtgctcgcagacctttggagcgtggcttccgaagaagagcagcgcgccattgcgaacgtgatggttaagcttgttgaaaacaacagctcacattaaggagagagtgtgttcactctctcttttttataggcgcgattttgcctgcggcaccgcttttatcgtttgcttttcgccccgacagggtaaacagcattcaggcgccgatacagcaggtttttcccgattttgggaaacggacgtttttcttatttaatcacaacattctgctttctaattaagacaaaatgctttatgataaaggaaggtaaatttttgccacgatgatgggtagggaggttatcatttggcaaagctcgaatggtacttagaatatgaaatccaagtcaaccgtcccggacttctgggagatatatcctctttattggggatgctttcaattaatattgtgaccattaacggcgtcgatacacaaagaagaggcctcttgttaaaatgccgtcatatagatcagattaagcgattggaatcgattttgaacacgatggatacgattaaagtcacgaagctccgcgaaccgaagcttcgcgaccgtctcgctgtaaggcacggccgctatatccagcgggatgcagacgataaaaaaacgttccggtttgaacgcgacgagctcggcttgcttgtcgattttatggctgagctgtttaaaaaagacgggcacaagctgatcgggatcaggggaatgccccgcgtcggcaagacggaatcaattgttgcttcaagcgtctgtgcaagcaaaaggtggctttttgtttcttcgacgctgctgaagcaaacgatcagaagccagctgattgccgatgagtacagtccggaaaatgttttcattttggacggcattgtgtcgacgagaagaggatctgaacgccatttgcagctcgtcagtgagattatgcgtctgccggcgaccaaagttgtcgagcatccggacattttcgtgcaaaatacggaatatacgatggacgattttgactacatcatcgaattgcgtaacagccccgatgaggtgattacatatgagcacgctgaagaaccgcagatgtttgaccattcaggtttttccggctttgatttttaaaatggaaggtgtttgttgtgactgaactaggaaatcggctgaaagaagccagagaggaaaaagggatgtcattggacgaccttcaggcggccacaaagatccaaaaaaggtatttaacggcccttgaagaaggaaactatgatatcattccggggaaattttatgtgagggcttttatcaagcagtacgccgaagctgtcggcctcgactcggagcacttgtttgaagagtttaaaaaagatatccctaattcttacaatgatgaggtttctgagaagctttcttcaatcaagccgcagagggagcttcccaagtctgcctcaaaagcgcttgaacttttgcccaccttgcttgtggcagccggcgttatcgttgtgatcgcgatcatttacgtcattgttcaggctgtaaacggcggagggaatcagcaggctgaagggcctaaaacagaggaatcgcaaagcaagtacgacgtctcaaaagattccccgctgactaaggaaaatcaacagaacacggatgcgcagaaagacagcgctgaaggcgacaaagaaaaaaaggatcagcagtctgatgagaacgacaagctgaccattaaagcgaccgcaagcgaaggctcttccacaacctatgaagtatcaggatccgacaagctggagcttgaagtaaaggcaagcgaaaactcatgggtcagagtgcgcgacgagaaaggaagctctcttaaagaaggaatgatgaaaaaaggggaaacctttcaaaagaatataaccgatcaatcgcaaattgatttgcggatcggatatgcgccgggcgttgaaattaaaatcaacggagaagttctttcttacaagctcgatcctaagactgtgatgacacaaaacataacgattcaaaataaaaaggaggaaaagtcatcttaattgcacagatgactttttcttgcgttcatcatcattaggaaaacatacatatatggaggaacctttatgtttaatttaccgaataaaatcacgctttctagaatcgcattaattcctgtttttatggtcatcatgcttgtgccgtttcagtggggggctgtctccttcggcagcgagtcgattccggtcacccatttgatcggcgcactgctgtttattttcgcttcggtcaccgattgggttgacggctattatgcaagaaagctgaaccttgtaacaaactttgggaaattccttgacccgcttgcagacaagctgctcgtgtcttccgctttgattattctggtgcattaccatcttgctccggcctggatggccattgtcattatcagccgggaatttgccgtaacgggactgcggctcgtccttgcgggaacgggggaagtcgtcgcagccaacatgcttggaaaagtgaaaacatgggcccagatcatcgcgatctctgcccttttgcttcacaatctcccatttgagcttgtatccttcccgttcggctctcttgctttatgggtggctgtctttttcacagtcgtatccggctgggattatttcgctaaaaactgggatgctttaaaaacatcgaactaaacgtagggaagtggaaacaatgaagttggaaagaaaagcggaaattatcgctgtcggctctgagcttctgctcggacaaatcgttaatacaaatgctcagtttatcagcaggcatttggccgaaatcggcattaacgtcttttatcacacggcggtgggagacaatccggagcgccttaaacaagtcattcagacagcgcagcaaaggtctgacttcatcattttttcgggaggcctcggaccgacgaaagacgatctgacaaaagaaacgatcgccgaagttgtcgggcgccctcttaagctcgacgatgaagccttcgaatcgattcaggattacttcaaaaaaacgaaccgggagatgtcgccgaacaaccgcaaacaggcgctgatcctcgaaggatccgatgttctgccgaaccgcttcgggatggctccgggaatgctgcttgagcatgaatcgcgcttttatatgcttctgccgggacctccgaaagagctggagccgatgtttgaaaacgaagcgaagccgctgattttggaaaagctcggctcgagggaaaagatcgtgtcaagggtgctgcgcttcttcggcatcggtgaatcccagcttgaaaccgatttggaagatctcatcgatgcgcagactaatccgacaatcgctccgcttgcggcagacggggaagtcacgctcaggcttacggcaaagcatgcggatccggaggagacaaaccgcttgttaaaagaaacggaagaccgcattttggagcgggtcggagaattcttttacgggtatgatgatacatccctcgcagaagagcttgcgaaagcatgccagagcaagggtatgactctggctgctgcggaaagctttacaggcgggcttttttccagctggctgacggaaatgagcggcgcttccgaatatttcaaaggcggcgccgtctgctacacaaacgaattgaaagtgtcagcggccggcgtttcggaagacacgctgcagcgctatggtgcggtcagcgcgcaatgcgctaaagagctcgccgcaggcatcagagtcaagacaggaagcgatatcggcatcagcttcactggagtagccgggccgaatacgcaagaaggccatccggctggaaaggtgtttatcggcatctccgtgaaggaccaggctgaggaagcgttcgaatttcagttcgccggatccaggtctgcggtgcggaagcgttctgccaaatacggctgccatctgttgctgaaaatgatggaaaaataagcggaaaccggattttcggaatatctttctttcgaaaaaggccattccattttaggagatcgatttttcctcttaaaaaaatcgaatatgcgttcgcttttttcttggcaaatccgcataaacaaggtatagtagatatagcggaagtgataaaggaggaaaatagaatgagtgatcgtcaggcagccttagatatggcgcttaaacaaatagaaaagcagtttggtaaaggttcgattatgaaactcggcgaacaaactgaaacgagaatttcaacagttccgagcggttctttagcgctcgatgcggctcttggagtgggcggatacccgcgcggccggattattgaagtatacgggcctgaaagctccggtaaaacgacggtggcgcttcatgcgattgccgaagttcagcagcagggcggacaagcggcgttcatcgacgccgaacacgcgcttgatcccgtctatgcacaaaagctgggcgtcaacattgatgagcttttgctgtcacagcctgatacgggcgagcaggcgctcgaaatcgctgaagcccttgtcagaagcggagcggtggatatcgttgtcatcgactctgtagcagcgcttgtgccgaaagctgaaatcgaaggagatatgggggattcccacgtcggtttgcaggccagactgatgtctcaggcgcttcgcaagctttccggagcgatcaataaatcgaagaccatcgcgatctttatcaaccagattcgtgaaaaagtcggtgtcatgtttggaaatcctgagacgacgccaggcggaagagcgctgaaattctactcttctgtccgccttgaagtgcgccgcgcagagcagctgaaacaaggcaacgacgtcatggggaacaagacgaaaatcaaagtcgtgaaaaacaaagtggcacctccattccggacagccgaagtggacattatgtacggggaaggaatttcaaaagaaggggaaatcatcgacctcggaacagagcttgacatcgttcaaaagagcggtgcatggtactcttatcaggaggaacgccttggacaaggccgtgaaaacgccaaacagttcctgaaagaaaacaaggatatccttttgatgattcaagagcagatccgggagcactacggtttggatactggaggcgctgctcctgcacaggaagacgaggcccaagctcaggaagaactcgagttttaatcatgaaacgtgtgaaaggctgccggcccgatcggcagccttttactttattcttcgctttcaggcgcttctcttccatccatcctcttcatgagggcagtttgaaaggcgtttaatccagaaacgttaagaccgtaagcttgacaagtatttcccacacaattacaatgaaattgtatcacttgtttttcttaacatgattgataaacatttaaacttgacaagggctgtgaatccgcttcactccctgtgaaggttctgtatgttgagaagaagtacaatgtacatgccgacacttacttttagcaagacaagttcatagcaagaggaggtgaaagttatgagtcctttagcaattctcatctccattttgctgagcctattctgtttagttgttggctactatgttcgtaaaatcattgccgaagcaaaaatttcaggtgcgcgaaatgcagccgaacaaattcttggagacgcaaagcgggatgctgaagcgttgaaaaaagaagcccttcttgaagcaaaggacgagattcatacgcttcggatagaagctgaacaagaagttcgtgaaagacgaaatgagcttcaaaaacaagaaaaccgtttacttcaaaaggaagagaaccttgaccgaaaagatgaatcattagataaacgggaagcgatgttggagaagaaagatcattctctgaatgaacgacaacaacatattgaagagatggaaagcaaagtggatgaaatgattcgtatgcagcagtcagagttggagcgtatttcaagtctgacgcgagatgaagcgaagcaaatcattctggaacgggttgaaaacgagctttcccatgacatcgcgatcatgatgaaagaaagtgaaaatcgagcgaaagaagaggctgataaaaaggcgaaaaatattctttcattggctttacagcgctgtgcggcagatcatgtggccgagacaacggtttcagttgtcaaccttccaaatgatgagatgaaaggccgcattatcggacgtgaaggacgtaatatccgtacattggaaacattgacggggatcgatctgatcatcgacgatacgccggaagccgttatcctttcaggatttgatccgatcaggcgtgaaacagccaggatcgctcttgataaactcgttcaggatggccgcattcatcctgccagaatcgaagaaatggttgagaaatcccgccgtgaagtggatgattacatccgcgaaatgggtgaacagacgacgtttgaagttggagttcacggtcttcatcccgatttaatcaaaatcctcggccgcttgaagttcagaacgagctacggacagaatgtactgaaacattcaatggaagtggcgtttctgacaggcttgatggcttcagagctcggagaagacgtaacgctcgcaaaaagggcaggacttcttcatgatatcgggaaagcgattgaccatgaggtggaaggaagccacgttgaaatcggtgtggaactggccaccaagtataaagagcatccagttgtcatcaacagtatcgcatctcaccacggagatcaggagccgacttccatcatcgccgtgctcgtggccgcagccgatgcgctgtctgccgcaagaccaggcgcaagaagcgaaacgctcgaaaactatattcgcaggcttgaaaaactggaagaaatctccgaatcatacgaaggtgttgaaaaatcattcgcgatacaagcgggacgagaggtgcggatcatggtcaaacctgactcaatcaatgatcttgaagcccatcgtttggcgcgtgatattcgaaaacgaattgaggacgagcttgactaccctggacacatcaaggtaaccgtaatcagggaaacgagagccgttgaatacgcaaaataaagtggtgcgaatgcgccactttatttttttgtttccttgtgtaacactataattaaaacctatttaaaaaaagaaagggtcaaattatgagaattttatttattggagatgtcgtcggttcgcccggcagagacatgatcaaaacctatttgccgaagctgaagctcaaatataaaccgaatgccgtcatcgtcaacggagaaaacgccgcacacggaaaaggcattaccgaaaaaatatatcaccagctcattcaagctggagccgacgttctcacgatgggaaaccacacatgggataaaagggaaatatttgattttattgatgatgcgccgcagatcgtcagacccgccaattttcccgaaggcacgcctggaaaaggcatcacatacataaaaacaaacggttcgaaggaactggctgtgatcaatttgcaaggccgcacttttctgcctgcgatcgattgcccatttcgaaaagctgatgaattaatagaagaagcgtcaaaaagaacgccgttcatctttatcgattttcatgccgaagcgacaagcgaaaagcaggcgatcggctggtatacggacggccgcgtttcagcggttgtcggaacgcacacgcatgttcagacagcggacaaccgcattcttccgaaaggcacggcatatataacagacgtggggatgactgggccttacgacggtattctcggcgtcgaccgcgagacgattatcaagcgttttaaaacgagcctgcccgtccgttttgagattgccgaaggccgcacaactctgagcggagttgtcatcgacatcgacgaacagagcaagaaagccgttaaaattgaccggatattaattaatgacgaccacatgttttttgaataactaaacagaaaatcattttagaaaaatattaaaaggaaagcaggaatatcccggtcctatcgtgaatatagtaaaaatggaaggtaccctgctatttttgaaaagcaattaaaaggggatggctttgaaaatagcaacatctaataatgattgttctaatgaacactcacttatccattgtaaacttaagggggagcaggaatggaaatattaaaggtttcagcaaaatcaaatccaaactcggtcgcaggtgcgctcgcaggagtcttgagggaacgaggggctgcagaaattcaagcaatcggagctggggcattaaatcaggctgttaaagcggtagcgattgcacggggatttgtagcgccgagcggagtcgatctgatttgcattccggcgtttacggacattcaaattgacggtgaagaacgaacagcgattaagctaatcgtagagcctcgctgatagaaagatcactctttttcaaatgcttcaacctgcttacttttacgtaagcgggttgtttttggtttgtccgtttttgaaaaatcagccgggagaggatcaacatgaagatttttgatgcccactctgatttgctgctgaagctctggaaaaatccgaagctcaatgaatacagcgacccgtcgcttcaaacgccggtccaagcgcttttaaacggaaaggcgaaagtgcagtgtctggcgatttttctgcctgaaaccgtgccagacacaataaggcttgaaatggcgcttatgcagatccagctgtttcacgaaaaaattgcaaagtacaagcggatcaaactgatcaaaaataaagccgatatcgacaagctcaaaagcgatgaaaccggcatcattttaacgatggaaggctgtgagccgatcgcaaaaaacttaaggctgtttgacatcttttttcagctcggagtcagaagtttcggcctgacatggaactgggccaatacgttcgcagacggcgctttagaagaaagaaacgccggcttgacttcttacggggaaagactgattcgcaaggcgaacaaaaaccgggcatggacagatctctcccatttatccgaaaaaagcttttggggtgcgattgaaacggcggcgtatccgatcgcctctcattcgaatgcccgcagcctttgccctcatccgagaaatttaaaagacgatcaaatcaaagcgcttattgataagaacggcgtcatcggcttgacatttgtccctgaattcgtgagaaacggaaaaacgcctgtgatcaaagatatcctctcgcatattgaccatgtctgctctttaggaggcgagcggcatatcggattcgggtctgattttgacggcatcgaccgtgtcattccgaatcttgaagcccacaaagattacgggaatctgatcgaagcgctgcagcgctcatatacaccaagtcaagtcgacggatttctctttcaaaatttcatcagccgcatcccattttaaaaaaatatcatacatttttcagagggtgttcatctgttttctccagaaggacactggtgtttaccaagactgattatcgtgctacaatccttttgtaaagcgattttacaaagggggtctgttcatcttggacggaaatatgaaagcgcttatcaagaagccgggggagccgggcgccagcttcgagctcgtcccgattccgaagatcgacaaacacgaggtcctgatcaaagtcaaagccgcatcgatttgcggaaccgatgtccatatttataattgggatgaatgggcgaaaagcagggttaaaccgccttatgtgttcggccacgaattttccggcgaagttgttcaagtgggggaaaatgtgactacggtaaaagaaggggagtatgtttcggcagaaacgcacatcgtttgcggaaagtgcctgccgtgtttgaccggaaaagagcatgtctgcaaaaaaacgctgattctcggtgtcgatacagacggctgttttgctgaatatgtcaaaatgcccgccgcaaacatttggaaaaacccggccggcatgcctgaggatctcgcttctattcaagaaccgctcggaaatgccgtgcatacggttctgacgggaatgacggctggagtgaaagtcgctgtcgtcggctgcggaccgatcggactgatggccgtggcagttgcaaaagcgtctggggcggcgcaggtgatcgccatcgataaaaatgaatacaggctcgaccttgcattgcaaatgggggcaaccgatatcatctccgttgaaaaagaagatccgctcaaaaatgtaagcgctttaacaaatggtgaaggggcggacttggtttgcgaaatgtcaggccatccgacggcaatccgccaaagtttaaaaatggcggcaaacggaggacgggttcatgtcttaagcttgcctgagcatcccgtatgcatcgacatgacaaatgatatcgtctttaaaggattgacggtccaaggaattaccggccgcaaaatgtttgaaacgtggagacaggtcagcggtctcctccaatccggcacgattcaaatcaagcctgtcatcactcaccgtttcccgatggaagagtttgaaaaaggctttgaactgatgagaaaagggcaatgcggcaaagtcgtactgataccgtagaaaggagagattaatatgaaagaattcaattttttagcttccgagcttaatacaatgaaagaaaacggaacttttcaagagctgccgatcatcgaatcaatgcaaggatcaaccgtcaaaatgaaaggaaaagacattatacagctttcatccaataactatctcgggctgacgtctcatccgcgcctccaaaaagcggccgaagaggcggtcaaacggtacggagctggaaccggatcggtccgtacaatagccggaacattcaccatgcatgatgagctcgaaaagaagcttgcttcatttaaaaacactgaagcggcactcgtattccagtccggatttaccgcaaatcaaggcattctttcaagcattctcaccaaagatgatcttgttatctcagacgaattaaaccatgcttccatcattgacggcatcagactcaccaaagcgggcaaaaaagtatatcagcatgcggacatggaagatttagaaaagattttgaaaaagtcgatgaactacagaatgcgccttatcgttacagacggcgtgttttcgatggacggagacatcgcgccgctgcccgaaatcgtccggctcgctgaacagtatgacgcatttgtcatggtcgacgacgcgcacgcgtccggcgttctcggcgaaaacgggcgcggaacggttcaccatttcgggctggacgggaaggttcacattcaagtcggcacactcagcaaggcgatcggcgtattaggaggctatgcggccggatccaaggtgctgatcgactacttaaagcataaaggaagaccgtttctcttcagtacttcccatccgccggccgtcactgcggcatgcattgaagcggtcaatgtgctgatggaggaaccttcattgattaaaaagctttgggacaataccgcgcacttcaaaaaagagcttgaaaaaatcggccttccgctgattaagagcgaaacgccgattacgccgattttgatcggtgatgaagctgcggcatgccgcttctcaaacacgctttttgagctcggtttatttgcccaggccattgtatttccgaccgtcccgaaaggcaaagcgcggatcagaacgatcatgaccgcccagcattcgaaagaagagctcgataaagcgcttgaaatcattcaaaccggcgctaaaaaagcgggtctgctttaaactcatcgatttctttttgaacaaagcaaataaccattgataatcattttcagttagtgtacaatgatgggttctgggttgtgctgacaaccgagaacctttatactgaagagtggagctttgtttgaaaggagatcaaaaacatgaatgagaaacagcgcattgaaagcggacaggtcaatccatcggacaaaaaatccgagaaggattacagcaagtacttcgaagctgtttatgttccgccttcattaaaagatgcgaaaaaacgcggcaaagaagaggttaaataccataacgattttaaaatctcagagcagttcagaggcatgggcgaaggacggaagttttacatccgcacgtacggctgccagatgaatgagcacgataccgaagtgatggcagggattttcatggcgctcggctatgaaccgaccgactcgacggaagatgcaaacgtcattttgctcaacacgtgtgcgatccgggaaaacgcggaaaacaaagtgtttggcgaaatcggccatttaaaagctttgaaaaaagacaatccggatttgatcctcggagtctgcggatgtatgtcccaggaagaatcagtcgtcaaccggattttaaagaaacatccgttcgtcgacctgattttcggtacacacaatatccaccgcttgcccgaacttttgtcagaggcttatctgtcaaaagaaatggtcatcgaagtgtggtctaaagaaggcgatgtcattgaaaaccttccgaaagtccgcaccggcaaaattaaaggctgggtcaacatcatgtacggctgcgacaagttctgtacgtactgcatcgtgccgtacacaagaggaaaagaacgaagcagacgtcctgaagacatcatccaggaagtgagaaggcttgcggctgaaggctacaaagaaatcacgcttctcggacagaacgtcaacgcctacggcaaagattttgaggatatggaatacggactcggccacttgatggatgaactccgcaaaatcgacattccgcgaatccgcttcacgacaagccatccgcgcgattttgacgaccatctgatcgaggtgctcgcaaaaggcggaaaccttctggaccacatccatctgcctgtccagtccggaagctcggatgtcttgaaactgatggcgcgcaaatacgaccgggagcgctatcttgagcttgtcgccaaaattaaaaaagcgatgccgaacgcatccttaacaacggacattatcgtcggcttcccgaacgaaacagacgagcaatttgaagaaacgctctctttatacagagaggttgaatttgacagcgcctatacgttcatctactcgcctcgcgaaggaacgcctgctgccaaaatgaaagacaatgttccgatgcgcgtgaaaaaagaacggcttcagcggttaaatgaagtggtcaacgaaatttccgcgaagaaaatgaaggaatatgaggggcaggttgtcgaagtgttagtagagggtgaaagtaaaaacaaccctgatatccttgccggctatacacggaaaaacaagcttgtcaacttcaaaggaccaaaagaagcgatcggccagcttgtcaacgtgaaaatccaccaggcgaaaacttggtcgcttgacggggaaatggtaggagaagcaatcgaggtgaagtaaagtgacgctttatacgaaaaaagagattgttgcaaaagcgcgggagctcgcaaaaatgattgcagaaacggaagaagtcgactttttcaaaaaagcggaggcacagattaatgagaatgccaaaataacgggcataatcaaccaaatcaaagccctgcaaaagcaagccgtcaactttaaacattacgaaaagcacgaagcgcttaaacaaacggaagcaaagattgacgcgcttcaggaagagcttgacgagattccgatcattcaagagttcagagactcccaaatggaagtcaacgaccttcttcagcttgtcgcgcatacaatatcaaaccaagtgacaaacgagatcatcacatcgaccgggggagacctgctgaaaggcgagaccggttcaaaagtgaaaaattcatcaccgagctgttctctataatttggcggcgccttttaaggcgccgttttttttgaattcaatttcccgccgcgacggcttattgaaaagattcgtttttcggctgtctttttcttttctgatttaagtcaagtttatccttttacctgcatacacttaaacagattcattatatgggaatttattttgatttctcaaggaacgcacattagacgaatgcccagcataggataatacgaggaaaaacaaggaggcatgaccgaatgtctgaatacagggaaattatcactaaagcggtggtcgcgaaaggccggaaattcacccagtccactcatacaatctccccttcgcaaaagccaaccagtattttaggcggttggattatcaatcataagtatgacgctgaaaaaatcggaaaaaccgtggaaattgaagggacatatgatatcaacgtctggtattcatatgcggacaacaccaaaaccgaagttgtgacagaacgcgtttcctatgttgatgtcattaagctccggtatcgcgacaaaaattacttagatgatgaacacgaagtcattgcgaaagtgcttcagcagccgaactgccttgaagtgaccatttctccgaacggaaacaaagtggttgtacaggcggaaagagaatttttagcagaggtcgtcggcgagacgaaggtcgtcgtagaggtcaattctgattggacggaaagcgatgaagaagaagcgtgggaagaagagcttgatgaagaacttgaggatatcaatcccgagtttttggttggagatccagaagaataaaaggaagctagggaaacaccgccctagtttcttttttttcagcacgaatctttatggtataatgagtgttggaatcaatagaaacgtttatacatagtgagggattaaatatggcaggctacacgcctatgatacagcaatatttaaagattaaggcagagtatcaggatgcctttttattttttcgtcttggcgacttttatgagatgttttttgaagatgcaaaaaaggcgtctcaggagctcgaaatcacgctgacgagcagggacggaggatcaagcgaaagaatcccgatgtgcggggttccttatcattcctgctcttcgtatatcgaacagctcattaaaaaaggctataaagtcgcgatctgtgaacaggtggaggaccctaaatcggccaaaggagtcgtcaaaagggaagtcgtgcagctgatcacacccggcaccgtgatggacggcaaagggattcatgaaaatgaaaacaactttatcgcctctgtcagtaaatttcagcatacatacgggctcgctttttctgatttgacgacgggcgagaatttagtaacggctatcgaaaggcttgatgatgtcgtttccgagatttactctgtcggagcaagggaaatcgtcgtcagccgcaaccttgacgagaaagacgtcgcaatgctgaaagagcgctgcggcgccacgatctctttcgaggatgaacaagcggatgaagtgcctggcattgtgaacggactggggtccaaagagcttgtcgatacgtttatgaggctttacgtctacttgaagcggacgcagaaaagaagcctcgaccaccttcaaaacgttcaggcctacgagctcgaagaagcgatgaaaatcgatttgtactcgaaacgcaatcttgaactgacggaaacgatccgttcgaaaaacaaaaaaggctcgcttctttggcttttggatgaaacgaaaacggccatgggagggcggctgttaaagcaatggatcgacaggccgctgatcagaaagggacagatcgaagagcgccaggaaatcgttgaaacgctgatcgcccatctgtttgagcgggaagatttgcgcgaacggctgaaggaagtatacgacctcgagcggctcgccggaagggtcgcatacggcaacgtcaacgccagagatttgatccagctgaaggaatcgctgaaacaagtcccggccatcaaacagcttgtcggctccctcgaccatccgaaagcaaaagcgcgcgccgagaaaatcgatccgtgcggcgatcttttgaatcttttggaagacgcgctatacgagaatccgcctctttcattaaaagaggggaacttaatcaaagacggctaccacgcgaaactggatgaatacagggacgcaagcaagaacggaaaagactggatcgcaaggcttgagcagcaggaacgcgagtacacgggaatccgctctttaaaagtcggctttaacaaggtgttcggctattatattgaagtgacgaaagcgaacatccatctgcttgaagaaggccgctatgaacggaagcagacgctgaccaatgcagaacgctacatcacgccggagctgaaagaaaaagaagccctgattctcgaagcggaaaacaatatttgcgagctggagtatgagctgttttccgagcttcgcagcaaggtgaaggaatatatcccgcgcttgcagcagctggcaaaaatgatgagcgagcttgatgtgctccaatgttttgcgacgatcagcgaaaaccggcactatgttaagccggagttttccgatgatgtcgttcaggtgatcgacggacggcatccggtcgtagaaaaggtgatggacagccagtcttacgttccgaacagctgtgaaatgggcaaaggcaggcagatgcttttaatcaccgggccgaatatgtccgggaaaagcacgtatatgagacagatggcgctgatctccattttggcgcagatcggctgctttgttcctgcgaaaaaagcggtgctgccgatctttgatcagatctttacgagaattggcgcagcggatgatcttatatccggacagagcacgtttatggtggaaatgcttgaagccaaaaacgcgatcgtccatgcgacgaaaaacagcttgattttatttgacgaaatcggccggggtacgtccacttacgacggaatggcgcttgcacaagcgatcatcgagtacgttcacgagcacatcggcgcgaagactttattttccactcactaccacgagctgacgtcccttgaagaaaagctggacgatttgaagaatgtccacgttcgtgcggaagaatacgaaggaaaggtcgttttccttcaccagataaaagaaggagcagcagataaaagctacggtatccatgtcgcgcagctggctgaattgcccgacggtttgatcagcagggcgaaaacgatcctgaaagaacttgaatccggcgcaaaagaagccgctccatcaacggcaccgaatatggtaaaagaggcggcggaagaagccgcggcgactgttgcagatcaaccggcccagctgtcattttttgagacggacaagccaatagaaaaagagacgaagctctccaaaaaagagcaggctgttttagccgaatttaaagcgatggatctgctcgatatgacgcctatacaagtcatgaatgaactgtacaggctgcaaaaaaaattaaagtaacaaagaggtgagccaacttggcaaaaattgttcagctgcctgacgatttatcgaataaaatcgcggcgggtgaagtagtggaaaggccggcgtcggtcgtcaaagagcttgtcgaaaatgcaatcgatgcgaacagctccgtgattgaaatcgatgttgaagaagcgggtctcgcctcgattaaagtgcttgacgacggcgaagggatggacgcagaagactgcagaacggcttttttgcgtcatgccacaagcaaaatcaaagacgaaaacgacctgtttcgcgtcagaacgctcggatttcgcggagaagctttgccaagtatcgcgtctgtctcacacttaagcattaaaacgagcaccggagaaggggcaggcacccatttgacgctgcaggggggaagaatcatttccgagcaaaaagcgccaagccgcagaggaaccgaaattacggttaccaacctgtttttcaatacgccggcaaggctgaaatacatgaaaacgattcataccgagcttggcaacatcacagatgtggtcaacagaatcgcccttgcccatccggaagtttcgatcaggctgcgtcatcaagggaaaacgcttctgcagacaaacggaaacggcgatgtccgccacgtgcttgcggcgatttacggcacggcggttgccaaaaaaatgctcccgcttgaagcgagatctcttgactttgaagtgaagggctatatcgctcttcctgaaattacgcgcgcctcgcgaaattacatgtcatctgtcgtcaacggcagatacattaaaaacttcccgctcgtaaaagcgatccacgagggctaccatacgcttcttccgatcggccgccatccgatcacgttcattgaaatcaacatggacccgctccttgtggacgtcaacgtgcacccgtcaaagctggaggtcaggctgagcaaagagacggagcttcacgagctgattcgcgacgccatcaaagacgtctttaaacagcagcagctcattccaagcgtgcaggtcccgaaaaaaaccgcacctctgatcaataaaccagagcagcaaaagcttgatttcgaccaggtacgagaaccggcacctctttctgattctgatgttgaaagagagtataagccggagccttcgttttcggcgatgaaattaagctcgcttgtcaaagacccgccgccttccgctcccgtagagcgcgaagaaaacgtaatgcaggacaccgagcctgaatggcccggagctgaagagtatacgcctgaagccgcgccggccgtacaagcagaaccggaacaggcaggagagaacgtccaggacgaagagacgccaaaagaaagggtgccgatcatgtatccgatcggccaaatgcacggcacctacatacttgcccaaaatgaaaacgggctgtacatcatcgatcagcacgccgcacaggagcggatcaaatacgaatatttccgtgaaaaagtcggggaagtcgaatcggaagtccaggacctgcttgtgccgctgacattccattattcaaaaaatgaagcgctgacgatcgaccagcacttggacgatttagccaaagtcggcgtctttctcgaatcgttcggcgccggcagctatatcgtccgatgccacccgacatggtttccgaaaggggaagaaacgacgatcattgaagacatcattcagcaggtccttgatgaccgcacgatcgacatcaaaaaactgcgcgaagaagccgcaatcatgatgagctgcaaaggctccatcaaagccaatcatcacctgcgggacgacgaaatcaccgccctgctcgatgagctgcgcagaacatccgaccctttcacatgcccgcacggccggccgatcatcatccactactccacctatgagatggagaagatgtttaagcgggtaatgtaatttttaatcgctcacaacctttggtatatcaatggctgtgggcgattttgattttattgaccacattttgaccgcattaacactagacggcctgctttaaatcttgccgtctgtaagaagacaattaggaagcggcacgtatatcgtccgggtattctgttttatggatgattgtaagctataattctaagaaaatttggataaccaaaagagggcttctctttgagatcaggtctcataggcaaccattagtcagatttcgcagctgttttcatttttctagaaaatgttataatgaaaagccacgaaatgacttgaagagggggaattttgatgcattacataacggcatgcttaaacatcatcagcgataaagaccttaatgaaataatgaaggaattcaaaacacttgaggaaaaaacgaacaaagaagaagggtgtattcaattccatgcttatccgcttgaaccgtcggagcgcaaaataatgctctgggagatttgggaaaacgaagaagctgttaaagcccatttcacgaaaaaacacacaaaagatgttcaaaatcaacaattaacagaagtagaatggttaatcaaaagcaatgtgaatgattaaagcgcgaaacattcaatgacgaaaaattaacccccgtaatcgagtggaaaattgttggaggattgttgtccaacgctgccaacagtcatcattttcatttagaaatcatcagattattcatagcagtgattagaaaatttttttgtccgaggtactgtaatgatttgattcactgcatgatatgaagggatacaaaaagctcggttctgtcgatgtcaccgatgaaatcggtacaggcaaggacttcatcggcggttcgtacatgctttattcaaacggtcaaattgtccgaaaatacatatccggcggtgaagtgaaatacgaacttgtcagtcgcataccggaaagcagagtgaagaaaagcaacattgaaaaagctcttgattgggctaaagacacagttggggaattgtccggtggttatgatggttatagagcgataacaggtgttgaccctgtgactggtgaaaaactaaccgtcactgaccgtatcctgtccggtgtttctgtcatacccgctactaaagtagtcaaggtagggaaatatgctttcaaagccactaaaggtgcgaagacggcgaaaagggtttcgaatgccgagagaagtgctaatgctacgcctaaaattaatagaaaacaagctctcaatcaggcaaaagacttagctggcaacaacctacacgtcaatggcaggttggcgatgatataactaagaagggtgtagactataaaaactataaatatagttcaaatccaacccatcatggacgttactatgagtacgaaactcctgaaggattaagagtggttgttacccatactaacgataacagattacacgcacatgcaggtaagcctgacaaagaggcaaatcaattcaactatgactttaagaaagagagatatactaatatatacggtcctaatggagaccaccatatatactataaataaaaggtgaggaagttatgtcgtctcgtaatgaaattattaaacaaaaaaagcgataatgaatgcaaggaaatcgatgaaggaatttacttgcttagaactattagattttgaagagtttgattctccttggatagacttgttcgagccattactaaaacaatttcgaagaatagattccaaaccaacttattataaattaattggggattctaaagaaaacaatattttatggatagaaaattccctaagtttccttaaacaaaaaaaagagtggtttatcgttgttcccaaatgtttacaaccagtgtgggcaaatgttcgagttttagactattctaaagcaattcatgagctttgggaaatgtcagaacctgataatttcctaattgctgataaatctacaggaatgattgcaaaaatattttttgaagaacaacaatacgagatccatattggaaaatgtagtcttgataacattaaaaagaataactaagagaactatttaaacaccttgattggcaactgcctatcaaggttttttcatattcaaatccgacaaaaagggggataaaatgggggactttttctattccactttgtcatacgatagagacaagaaaaacgaacgtgaatatcgagtccaagaaggagagcctgcggacactgaccttttgcatatggatgttgtgcagctgattggtggccgcttttttattggccagaatgggagacgcacctttcccttatcaagtgtgaactcggatgtatcgaatgatgatgaaggtcgtcagcttcacaggaggaacggctggaggctggagtctatgcaggattgcgcgcgatagtcaggggacgcagggaagtccttataagaacaaaaagaaaagcaggcaaataacctgcttaaaaactgattttgcccttgaaatagactcgcaaaatcaaatctcgggtctttctgttaagcaaagagagagccaacaaagcgagaaagagttactttgcgatgcaatttttaaattgccgctccagttcctctttgtccaagtcctttccgatgaaaacaagttcgctttgttttttctcgttttcgttccacttccggtccggacgtcctgaaaacagcatatgaagcccttggaatacgattcgatattcttcgcctttaatataaaggatccctttataacgcaataaatcttctcctttttcccgtacgagataactcatccaatgatccacctttgccaaatcaagaggcttctcttcccgaaaagcgatagaagacactttatcatcgtgatggtggtgatgatgatcttctagaaaatgaggatcgatttcaatttttcgattgacgtcgaacgtattgatccccagtatatctcttaaattgaccttgcaatctctggcatacagcctcttagccgtaggattaatgttgacaagtctttgctccaaggatttcagctcgttattcgatactaaatctgttttattgaggatgatgacgtcagcaaatgcgatttgctcttgcgcttcatcctgatcatccagatgtctggtgacatgcttgctgtctactaccgtgacgatgctgtcaacttcaaatatttcggatagcagttcatccatgaaaaacgtctgggcaacgggggcaggatcagccagtcccgttgtttcgattaaaacgcgatcaaatgcaactttcccttgatccattgagaatacaagcgttctcagaatgcgaatcaaatctccgcggaccgtgcaacagatacagccgttgttcatttccaaaatttcttcttcagaatcaacgacaagctggttgtctatcccgacttctccgtactcattgacaataaccgcgatcttttgattgtgcttttctgtaagtattcgatttaaaagtgtggttttcccggcgcctaagtacccagtgagaatagcgacaggaattttctttttagttataggcatgatcattcgactccatttaaaattttttcgatactttgattactttttcttttggaactccggagatgacgccggatgaacgttcgaagcgttggccgtcatacaaatggcttgctttttctttataatcttcattggtacaaagcgagtcaatcaggagggggacatcctcaggttttaaatctctataccaagttcctctcgggtaatggatggccacgcacttatcttgacaccttccattacaccgcgtgcgcgttgtatgaatgaaatcatcaagctcccggtccgagatttcttgccgaatcacttgagtcagttcctcagctccggcccgattgcagctgctgccgttgcagataaaaatatgatgtttcatattacttaaatcccatgtcgccatatgtatcttccctccaaataaaacagaattattccgatttgtaagcgataaaatgataaagaactgagaatgaatatagaggcgccccggtcgatcactgtccgaaaggtgatactcataacggggagacggccccggcaacatccgcagtatttcactcctttcgaaaagctccatatatttcagccttcttttgcgcctttggttatttcaatactacaacaaaacgtaattattacgatttgaaaatcattttatctctttttcaagtcaaacgcaaatagaagaggttaaacggtgccaatgagatctgtgcagcttctttatccagccgcaccttggcgcaaaaaccccttgagcaatcaaggggttttttatctatagcaatttttccattgccattacatcgataaaacgtccatctaaaattccttgatttttaaagatgccaacttgcctgtagcccattttattgtataggttttgcccaagttcgttaaagggaaatgtaaagaggacgattttataaaaactattctctttagctgttttttctagagcttgaagaaggaggccgcctattccttttccgcggcatgcacgatcaacatagacagaaaggtcggcaacaccttgataagcacaacggtgggagtacgggttcaaagaagcccagcctacaatttctccttttgattcggccacaaggacagaatagcgcccttgatgttcctgaaaccatatttcgatatcgctcatttcctttaaatcttgctccagagtcgcaattcgatcttcaatgccctgattataaatagttaagataaatggcaaatcggcagaaatagcttttcgaatgtttatgttatgcatgagttcctccgtagaaggacttcgagtgcagcatcatatgataagttggtcactaaattgtccgcaagtttttgaaagcgcgttcgttattgtttgcttgacggatctaagcggaattggcaacagacagggtaaaagagagcaggcctaagctttgctctctatttttttgacacttcatctttgaataaatgtttctatttcccgttacttgatatcgatggccgaagctttattgtcccaatcagaagccatattagcagttttgccgtaccaatcggaatgtctaaacaaaacgcctttgccgtatccttgagttgaagtatgctcccacagcgtcgttgaatagcttgatgaaggagacgccgtacttaacgatgaaattctgtcattccagctggatggcaagtttttaaatccgtctctccagtaaatatactgcccgcctttatttttatattcatagaaatcggtacagcagggaccgctggcagaaggtttgaattgcttctcaagcctctgcttgtctttcgcgataaaggcttctaaagtaaccttgctcgtaaatccatacgcaagcaaatcgccgttcttattctgcttgggcagaaccatggttactttgacatctctgacggatttggcgttggcttgagccggcgaatccacattttttccgtcaacggttaagtagtggaaagatttgaccgtatattgattccgctgctgatcgtccagtttcactttaacatcgctttcattttgcgacgcagcgcttgccgtcgacgcggaaatcaaacaggcagcggcaacgagtccaatcccaattgttttcttgaacttagttttaaacatataacaacactccctctcttaattttcctatttattaataggatggaaaaataatagcattaatagaatgaaaatcatgtctctttttgaaaaaaacattaattttctattaacattcagcagcaggagaggttcggtatctgtattgcattaaaaaaaggctcttttttaaaaaagagcctttcatgatggagtcaacaacggtaagcaggaggagaacatgtaaaataaggagaaggtcataagttattgctgacttttaaaacgaactttttagtagcctccatatccaccgccgaaccagctggcgccgatgatgattaagagaatgaacagaacaacaattaaagcaaaaccgcttccgtgtccgtaacctccgctcatatgtttcacctccctaaagagacatagtttatcctatgtcactttataaatttggtataggatattgatttacatttttaaaaatagttgaaccaacttcaccctcatgcgagtctcagatgaagagccgactatcatgaggacttcgtgcagagaggatgaaaatggtgattggcgtcctttaaacggaatataatgcaataaatccaccgaaaagggcgctgaataaattgaattttcaattaactgaaaaagacatgcttcgtatcatcaggaatggtcttcaaacggcacagtaccctaagcatatgatgatcgttggtgccgggttgtccggacttatcgcagcgtctttattaaagaatgccgggcatagagtgacgattgtggaagcaaatgacagagcgggagggcgtgtttttacttcccgtgcgccctttagcgaagggttgtatttcaatgccgggccgatgcgcatccccgatatccatactttaacgatggaatatattaagaagtttaatctgcctgtcaatgtgtttatcaaccgaacccccatggatattctttacgtcaacggcgtgaaaacccgtcttcatgagtttgaaaaaaatccgggcgttttaaggttccctgttgctccccatgagtagggaaaaacggcagaacagctgatgctttctgctttgcagcctatcctcaattttatcagccaagatccggcgagaaattggcgtattgttgaagaacaatacaggaacgaatcgttaggatcttttctcaacactcatttttcaagcggttccatcgatatgattggtgtgcttttggacatggaagcgtacatgggattgtcccttgtcgaagtattgcgggaatcgattttttttacatcgccgactcgcttctatgagattacaggcggcatggacctgttgacgcaagcttttcttccgcaattaaaggggaatattttattccgtcaaaaattgatgaaaatgtctcaaactaaaaacagtgtaacagcccattgcattcaccagcagtcggcagaacattcagcggtgacaggtgacttcgcgatcgtaacaatacctttttcagcattgcgatttgtggcatttgagccgtttgaatccttttcctaccaaaagcggagagcgattcgggagcttaactatattgcggcgacaaaaataggaatcgaatttaagagcaggttttgggaaagagtcggacagcgcggcggcagatcgattaccgatttgccgattcgcttttcatactaccctagcagcataggaggacacgggcatgctgtcattttagcgagctatacgtgggctgatgaagcgctaatatgggacagtcagcctgaagaagagcggatccgctatacgctgaaaaatttagcgaaaatatatggagatatcgtgtattctgagtttgtatcaggcgcttctttcagctggacgcaaaatcctttttcagccggagcatttacagctttcgaaccagggcaggaattagagttgtatccttatattccgatgcctgaaggaagggtgtatttcgccggggaacacgcttccctcactcatgggtggatgcagggagcgattgaatcgggaatacgggcggcgtatgaagtaaatcaggcctcccgcgtataacatgaactttgcaagtattttaatagaaagaaccgattttaagggatggggaagagtcgctgttaaaaagcggcttgttcgtttttattgagttaaacagacggatcttccaataaactccgccttctgaggggatgtaaatttgtttttgcttcctcaacagtaagaagtgtttccattcgtaaaaacaagtttttaagaacttcatttataaaaaattttaatgcttatgatacaattgaattgcagatgtaactcgacaagcaaaaaagtgttttgctgaggtgaatgatcggattgcccgcattttttcgttaagaaccctcctttttcttacaacaaaaaaagcccccaaaacgagttttcccttaggaaaggctcatgacataccggatggaatgacttaacattctgccgggcagaatagctaagaaaggattgaatcacattgaatgctgctcgtgatcgaaacatcatgcttttgcttctctgtttgacagcaggtattgtagatgtgattgggtacttaagtatcggtcacgtatttaccgctaatatgaccgggaacatcgtactgttaggattatcaatcggcaattctcttcatgcgaccgccgtgtactcgctgatcgcactgttcggatttatcatcggcgtgattatatcagcagccattgtcggaaaacaggaaaaatcgttctggccgacaggcgtcacgattgcacttgctgtggaagcagccgtattgcttctatttgcctgcctgactttctttgaaagttcgccgcaccttttaatcttgctgttaagcattgcgatggggcttcagactacggcagccagaaagctcggcattgcagggatttccactactgtcctaacggggacgctggcaaactttttcgaagatgtgacaaaacgattcctcagtaataacaaccaaaaggtcatccataaggacgcatggcttcgcgctttgacgattgtgctctattgcctgggggctgtcattgccgcacttgctgaacctgagcatccgtttgttgtgatttggattccgatcgttatcattatcggtattattgcggttgcaggcacaaggtttcacggaaagagtgagggatgaccagataaggacggttctatacaccggcattcgtgaaccatcgattgttacatatgttttatgaaggtgcaagtccgggtaataggacggggaaaagcaccagtatcggttaagattgggaggaggataaatggttggaacacattaatatggagcagtttattttattagcggccttattgctgattatcggtgtactgacaacgaaattttcgactaggctcggagtgcccgcccttgtattgttcttgattgtcgggatgatcatggggagcgatggtctcggaattatttattttaataatcccgagcttgcccagctgattggaattatcgcacttgtcgtcatcctttttgaaggcggtttgcaaacaaagtggtcttcggtcaaagcggtcgccgttccttcattgtcgctcgcgacgattggcgttttgctgaccacctgcgtggttgcggttgccgccaagctgatttttaatgtttcttggatggagggctttttattcggagcgattgtcggctctacagacgcagccgcgattttcgccgtattgaaaggccagaatattagagacagattgagctccactctagaagcagagtcgggtacaaatgatccgatggcgatgtttttgactttatcgctcatccagctgctgacggctgaccattcatcttatttcatgcttgttatttcatttttctggcagatgggaatgggacttttgctcggatatttactcgggcggttcgccagctttgccatcaataaaatcaacttggattcgagcggactttatccgatcttcgctcttgcttttgcgcttcttacctacagtcttacagatgtcatcggggcgagcggcttactggccgtctacattgccgcgcttgtcatcggaaatcaagatttgacttaccgacattccattttcaggtttaatgaaggctttgcctggatgatgcagattttgatgtttatcattctcggattattggtttttcctgcccaatttttatccttcgatattattttcaagggcttcttgctttccctgattttaatttttatcgcccggccggttgccgtttttctgtcgaccatcaaaatgggctttaattttaacgaaaaaatcttcttatcatgggccggattaaaaggggcagtcccgatcgttcttgcaacatttccgatgacgatggggcttgaaaacagccaattgatctttaatgtcgtattcttcgtcgttttaacatcggctttgatccaagggtcaaccatatcggtcttcgcagaaaaattgaaattgaacggaccgcagaaagtagaagcgccgcattcgctggagcttgtttccatcggcaaggcgaacgccgaaattatcgaatttgaagtcgatgaccaagcagccattaccaggcagatgctgaaagacatcagctttccaaaagatgccctgatcaatgcgatcatccgaaatggggatttggtcacgccgcatggagaaacgaaaattaaaccaggcgatattttatatatcctcgtatcgaaaaaacaaaagaaggaactgaaaaaatttttaaacagagaatttgattaagccgtcggaaaagcacagtacaaggcagacttgctcagtatgtcacgaataaaggtcaatgaagggtactgcaccggtattcttcattggcctttttttgccatgtggaagttcagctatatgataagtgacatttagacctttgttgatcaattgctcatatccatttataatttaaaaatcaaatattaggaggcgcatgaatgatgaagtgcaaaaaaataagtgggttaacattcgaggggaaagcgcatcattaaccctataaactgcgtgattcccctttaattttgggggtatcattcaattgaaaaacagtaaaatacaaacctttaaacatcaaaagaaggcattttggtggcttagctttgtcgctttcttcagcgtgatgaacgaaaccgtatttaatgttgcattgccggacataaaaaatcaattcggcgtgtcgcctgcggcggcaaattgggtgaatacgagtttcatcatttcctttgctgccggttcagttgtttacagcaggctttctgatatgtacggcgtcaggaagctgtttgtggccggactgctcatctatggcggaggctcatttatgggtttgttggctcaagcttatttcccggctgtgatctttgcgcgctttgttcaaggatccggggcttccgctgtacccgcgcttatcctggtcatcatcacgcgctatgtccgtccggagggccggggcaaagcattcggcattgtcggatcactggtggcaatgggcgagggaataggtccggccatcggcggaatgattgattgtacattatattcattggtcgtttctgtttattctgccgatggcagtgctgatggcgattcctttcttctttagaaatatgcctgatgaagccgctgcaaaagcaaacctggatatcattgggatcggactgctgacaatcagcattgtgatgttcgctgtatatatatcgctgtatcatgtcttttatttactggcgggcattttttgcttgattggagctgcagttcatacccgacatgcagaacatccgtttattgaccgttctttaataaagaatcgccgatatataggcgtcgttttggcaggatgtactgtattgggaagcgttgcgggaatcgtctctgtcgttccttatatgatgagagtcttgtttagcttaaatgccgatactatcgggagcggcatcttacttccgggcactgtgggcgttatctttttcggcgttgcgggcggagcccttacagatcgcttcggcagccggtttgtttttactcttggatggttattgatcttgtcaaccatggcagccgcgtcacaggtcggcgaccggacaccatggttgatgacgattatgctcgtgtttatatttggcggtctttcatttgtgaaaacggcaatttcaaacagtaccgcagaaagcttggaagaaaaggctgcaggcgctggaatggggatgctgaactttgcctgttttttatctgaaggaataggcgtcgcattagcaggaggcttgatggcagtgcacgggtttggctattctgcgcttccggcaatgaacgatgcctggagtgctgtattcagccgctcgtttgccatattcacagtttttgtattggctggcggattgctatatttattgacttgcaaacgcaaaaaatcttaggatattcgagtggttgggcgggaaagcccagccgttttttatgctgactcgattttctgaaacataatgaaaagaaaatcgtatttgatgtaaagcttcttgagaggatgaaaatgatgaaaagaagcatcggcacctttgaaattgacggactgacaattgaatattcgcgagtaggtgaagggaagccgattcttgtgatgcacggaggtcattcgaattgccgcgaggaatttgggtatcgagatctttatgagagccgattctctatcatcacgccttcccgtgcagggtatggccggacatcgaaagaaatcggggacagtttggaacttgcctgctattacatatgaaactgcttgatcatttaaatatcaagaaagttcatgtggttgcggtgtcagccggcgggccaagcggaatatgttttgcatccaaatactcggaaagagtagaatccttaattttgcaaagcgctgtcacaaagcagtggctgacagcgaaggatattgaatataaagttggtcagatcatctttcggccgcctgttgaaaaggccgtatggaagctgatatcggcgcttaacaatcgatttccggaatggatctttaagaaaatgctatcctcctttactacacttcctgctgatcaggcgatgctgaaagtcacggagggagatattgaagaaatgagaaaaatgaacaacagacagcgttcaagtcgagggttcttgcttgatttaaaaaatatagacgatttatctttccatcatttgaaggagatttcttgtccggtattaattatgcattgccgatatgatcgtgttgttccagccgagcatgcttttcatgcaaaaaaactgattcctttttcagaagtctatcaggcagacagctggggtcatctcatttggctgggaacagagggtaaatctgtctcacagaaggtcatcagctttttaaaaaccacatcatcttgatcataagatgaataaaattttaggatcgcagcctacccgcaaatgaagtagtgcaattttttaatcaagagcagaatgatctttccgaacagaactgatgaacgtcgtacaagacttgcaaataagatgaatgagaaatcctccctggccggttttcggagcacaagggaaacttatgtataagaatctattccgatagagggacaggtacgggatgaatcattgattaccgttgcctgcgatttcccaggggggagagagttggtaaacttgatatcatccgcgggtttgctttgcttggcattcttttagcccatagggaagtcgtctttggctgtggatatttcaatttgggcctgctgaatggatatggcgcagtttggcttgcggcaagcggcagcttcttcctaaactcgcgattgaaacgatgcggctatgcaatatggtgaaacgttgcatgaaaaacttaacattttaaaaatccagccgatatgatgaataaataactgcacgcttccggcaaatgtggtatggtagctagtaagtttaggaaaagggaggatattgatgatcatcgtcacaacagatacaatcgcaaatcaaaacattgtcgaagtcaaagggcttgtcacaagcagcatcgttcagtcgcggaatatcggaaaagatattctgtcagggttgaagtcagtcattggcggagaattaaaaaattacacccaaatgcttgaggattcgaaaaaagctgtgagggaacggctcgtgaatcaagctgaagagcttggagcaaacgcgatcgtcggtctaaggttcgaactgtctgcaggccagggaacctccgaactcatcggatatggtacggctgttgtaatcggctagcttgcaatcgaaaacgaaggcggcggctctcgttgccgcctcagcgagtcaagaaggcttccctgtctgtttcgtctctttatgtttttgagtcagatggggatactttctgtggatgacaaacgctatgatcgccatatataagccgtagacgccgacagagagcagcttgttttcgctgaaattggcacctgcgatagagacgacgagaacgttggggacttttccaagcgtcgaagccgcaaaaaagacagcccatttcaccttgcttaaaccgcagacgatattcatgacaacggctgggataaccgggatcagcctgcccaatagtacggctgtaaaagcattttggttaaaatacgcttcatattcgctcattttcgggtatttcgttaagtgtctgcgagccatgtctctgaatccgtaacgtgagaggaaaaacaagagcatggtgccgagcatagaccccgtcagcgtgatcagcacgccgtttgcgattccgaacaaggcgccgtttaatccggcaatgagcgcaaacgggacgatcgggaaaaatacacaggccgccacaagcagcatgctgaataataccgaataaacgcctccgtccctgatgacgtcgagccaggaatctttgcagacgaatccgaccgcgatgatacttgccatgatgatgatagtgaatagttttctgatcataccgctcccgctgcctttctttgtctttagcttctacatttgcaataaagcttcttctaagtgtgccaaaatctcgtcagtttttgagaggttgcaattgctgagcataatcagcacttttttctcatccatgtatcggttaattgagctgataaaaccgtggatttctccatcatgccatattttatacttattttgatgattaataaaccatccgtatccgatcgaattgttttgaatgagcgccggagaagggccttcggctgcaaaagcctgctttttgacgcggctgtaaagggcttctttcaaagcatcttttgagacaagcttctcggtgtaaagcgccctgtcccataagtacaagtcttcaacggttgaatacagcccgctttccccgtagccgtatacgataggcgctttgatcatttcacgattcaggcataaatatccgactgtaggcgaaatatcttccggagaagagaaaaaaccggagtttttcatgcctaaagggtcaaagatcaattgttgaataacgtctccataagcttcatttgtgatcgtttcaatgatttttgtaagcagtatgtatcctgaattactgtaattgaacctttgtcccggccgaaattcaagcggcttgtcaataaaacgtctgataaattggtccaacggtgcgcgctccagctcaatatcgagcaattcttcctctagaaaatcaggaattccggacgtatggcttaataaatgtttgatggtaatgctgtcgccgttcggatagccttctaaatagttttgtaccgggtcatctgtacgaagcagccccttttcttgcagctgcatgaccgctatagctgtgaattgctttgtcagtgaggcaatttggtagcgtgtagacggttcattcttcaccttgtccttacaattggcataaccgtatcctttcgataacagtataccgtttgaatctgccagcaaaatgctgccgtgaaaatgattgttggatgcttgttccattaaataatcatcaagatgttccgctgtatataccaataacaacagtcctttcatatctaattatgataagaagaaaacaataaacgatagttttgaaaggaaatgaagcaggaagcgcgaccaaaataacattataaaaatttttttgtattttccatcatttgcagaataatttaagctaaatttaaaataaggcaatttcatgacatccgttaaaacgagtgctgttttgacggatgttttttattataaaacgattgaaatataagtcggcagtaacgaaaaggggaataaagtcgtacacagccttaaactaagggctaaagttctgtgtttttttgcaaggaaaaggactatattagtattttttaattttaatttaattttgaagggtttttcctttatgatctataatatgttatttaacatagtgaaagagatttttaaatctttggtgctgtcatgaagcaaaaataacaggaggttaagaaatgggacataaacatatcgcgatttttaatattccggctcacggccatattaatccaacgctagctttaacggcaagccttgtcaaacgcggttatcgggtaacatatccggtgacggatgagtttgtgaaggctgttgaggaaactggggcagagccgctcaactaccgctcaactttaaatatcgatccgcagcaaattcgggagctgatgaaaaataaaaaagatatgtcgcaggctccgctgatgtttatcaaagaaatggaggaggttcttcctcagcttgaagcgctctatgagaatgacaagccagaccttatcctttttgactttatggccatggcgggaaaactgctggctgagaagtttggaatagaggcggtccgcctttgttctacatatgcacagaacgaacattttacattcagatccatttctgaagagtttaagatcgagctgacgcctgagcaagaggatgctttgaaaaattcgaatcttccgtcatttaactttgaggatatgttcgagcctgcaaaattgaacattgtctttatgcctcgtgcttttcagccttacggcgaaacgtttgatgagcggttctcttttgttggtccttctcttgccaaacgcaagtttcaggaaaaagaaacgccgattatttcggacagcggccgtcctgtcatgctgatatctttagggacggcgttcaatgcctggccggaattttatcatatgtgcatagaagcattcagggacacgaagtggcaggttatcatggctgttggcacgacaatcgatcctgaaagctttgatgacatacctgagaacttttcgattcatcagcgcgttcctcagctggagatcctgaagaaagcggagctgttcatcacccatgggggtatgaacagtacgatggaagggttgaatgccggtgtaccgctcgttgccgttccgcaaatgcctgaacaggaaatcactgcccgccgcgtcgaagagcttgggcttggcaagcatttgcagccggaagacacaacagcagcttcactgcgggaagccgtctctcagacggatggtgacccgcatgtcctgaaacggatacaggacatgcaaaagcacattaaacaagccggaggggccgagaaagccgcagatgaaattgaggcatttttagcacccgcaggagtaaaataaccatttaaacgaacccgggaatccccgggttttttgttgctgccgtaaggaagcgggaaaagtatacagcggcgctttttgaacatactaccttctattaaatgtattaaaaaggaggaagtgttttgtcaaatcagggcaatttcaaaaaaacgatctctctgcttgacctgattttgatcggcatgggtgcgatattcggatcggcttggctgtttgccgtcagcaatgtcgcttcaaaagccgggcccgctggaagcttttcgtggattatcggcggcgtcattatccttttaatcggcctcgtttatgccgagctgggagctgcgttgccgcggacgggcgggattatccgctatccggtgtatacccacggccaccttgtcggatatttgatttcatttatcacgattgttgcctatacaagcctgatttcgatcgaagtgacggctgtcaggcaatacgtagcctattggtttcccggtttgacgataaaaggttctgaatcgccgacgattatcggctggcttttgcagtttgcgctgctttgtttgttctttttactgaattattggagtgtcaaagcgtttgcgaaatcaaatttaattatttcggtttttaagtattttgttcctttgacaatcatcatcgtgttgatattccattttaaatcggcgaactttgcgggagaatttgcgccgtttggctttggcggggttcagacatccatttcgaccggcggggtgatgttcgcatacctcggtctacatccgatcgtttcggtcgccggcgaagtgaaaaatccgcagcggaacatcccggttgctctgctgatttgcatcattgtttcggcttgcgtctatacgatactgcaagtggtgtttatcggagccataccgactgatatgctaaatgacggatggaaagcgatcggcagggaattttctcttccgtttaaagatatcgcggtgctgctcgggatgggctggcttgccactcttgtcgttctggatgcgattttatcacccggcggaaacggcaatatttttatgaatacaacatcgcgcttggtttatgcatgggcgcggaacggcacattgttcaaaatctttgccaaggtgaataaaccaacgggaattccgcgtccgtcgttgtggctgtcgtttgcgctcgccgttttttggacgcttccgtttccgtcttgggacgcgctcgtcaatgtttgctctgttgccctgatcctctcctatgcgattgctccggtttcagcagcggcgctgaatgtgaatgccaagcagcttaaaaagcctctgcaaatcaaaggaatggctgtcatcgctcctgtctccttcatatttgcgtcgtatatcgtctattggtcagggtggaacaccgtgtcatggctgctcggatcacagcttgtgatgtttgctgtttattgcgcgtgtaaaaaatacgttccgcaggacgatgtttcgtttgcacagcagcttaaatcaagctggtggatcgtcggatattatgtgatgctcctgattttatcgtttctgggctcattcggtaacggccttggcctattgagaacgccggtcgatttaatcttgatcgcgctaggatcgattgcggtattttactgggcgaaatatacggcgctgccaaaggcagtcattgattatgatgagaaaaaagaagaaaccgtttaagtatgaaaaccccgctgtatggactgcggggtattcacacgtttttattacagttgcggaagatctttagccgtttcggcagctttggtatcaatctgaatttgttcagataaattcgcaggatggtaataccctttggaaatcatatagtttgtgatctgttcatgggtgtcaatcgcgtcgtttaaatactgcttaagcgtttcgcgcacttctggagaagatgtttccgtgatagctgtggcaatgtttttgacaccggtttttgccgagattaaaaaatcggtggcaatgacttgttcagtcatcgcgcccatgcctgtcatgttttggatgaattcgttcatacggtttcacctctcactgacaatagaccttgtaaatgctcgatctgatgctttgtttgggatgcatcacgctccaagatgtcgcgaagctcttgatcctgaaccattcccgtcattgttgatgactttgtcagacaaaggtttttaaacattaacagctcatgcagctccaatgtttcatggatcgcattattcaatcgcaaacattcctttcaaatttgttattgtgtgaaggacacatctttagtatcaaaattcgttagcgggattattcggtttgttattttacaataaatcacataatgatgtcagacttttcggacgcgaaagaatttggtcaagagccatgttccttgcggaaaactgagtgtgagctgccagacgccgccgccgtcaagtccgtattcggtgatcagctgcagtttttttccgatgctgcgtgcgtcttcaaaccatacgacatgccgtctgccctgttcatcggtgtatctgaaaaaaggggactcagaatttgtatcatattgaatcggtgcctggtgcttcatggcgagctgaacggcgtcttggttggcgattccggggtatacggcaccgggctgatagggcagggtccagttatagccgtaaagcggaaagccgagaacgattttttctttggggacatggcggagagcaaattgaattgtttgccggacttcattgatcggagcaatggggccgggctcgcttgtcccgtggtgccagtcgtatgccatgatgaagataaggtcgctcactgcaccgattccgccatagtcataccctttcagccaggcgatattttcatttgttttcggcggaacggcaatcgtcaacacatagccggacggcttcagccgctctttcaacaggcggagaaaacctgaaaataaatctctgtcttcctccaaaatctgttcgaaatcaatattgacgcctgcatatccttttctggaaatcgtttggacaatattgtcgatgaggcgatttcttacggcaggctgatttaatacgcggtgcgcaagagacggactgaagcctgattcagttagattggtgactgtcatgaggggaggaacgcgccgtctccaagccgtttgtacggccggtgaatcattcagctcgcttaacgatccgtcgcttgaaatgtggtattcaaaaaatgccagatacgtggcgtatggggcaaaattatgaatcaattcctggtctaaccgggggtttctcagtgtgtaatatcctaaagcagtgatcggttttttcggcaattccggaatcatcacttttatccccggcctcatattggaaggggttacagacggatttgctttttgcaatgcttcgacggatacaaacgtccggcgggcaatcgtgtaataactgtctcccggctgaacggtatatgtataaagcggtattaaaagagcctgtccggggacaatgtttgttgcgatcaacccattcgccaatcggatctggtcaatcgaaattccgaacttggcgccgatgacaaatagtgaatctcccggctggactgtataaataaacaactggcacacttccttttgttcctctgtatgtgacagggggttttatgctatgtctatgaccgttgcagaaggatcatgcgccgttttttacagctggaatggtgaatagaaccgtgaagcggataattcttgactgaacagttagaaagtgtatccttcaaataaaggaggtgataggggcttgggaaggagcaaagaatttgataccgctctcgtccttcataaagcgatggaggttttcggccaattcggctatgagggggcgtcgatgcaggagctgctcagccgcctgggaattgccaggcaaagtctgtacaatgcattcgggactaaaaggggtctgtttatcgccgcccttacaagatatctagatgataaaaatgcgcaagtgatcgccatgcttgaaagccccggatcagtgaagcaatcggttcggcagatcttccaggaaagcttaaacgttctgaaagaccccgaacgttcaaaggcatgctatatcatcaacagcgcaattgaacaaattccccgcgatccggaggttgccgaatacttcgataagcagacaaagcagttggaaaccgccttttacaaagcgcttgtccgagcacagtcacagggggaactaaagaagggcctccatgatctttcagcagttgcccgttttttgaatcaaacccggctgtcgctcacgtttcaggcgaagttaacgggggattttgatgcccttcaggatctgatcgatgtcagcctgtctattcttgattgatatattgtttgtcatggggagatgggctgctgcccgtttttatcactattttagactgattggtcaaaaaagaatggaggaaagaaaatgacgcgtgcgataaccgatgtgatggaactgtttttgcagtcgatgcttgaaaaggatatggaaaagtggatacagctttgggatcaagatgcggtgtttgagcatccatacgcaccgccggtttttcctaaaaaaatagaaggtaagtcagcgatttacgattatataaaggattttcccgaaaaaatcgatattgtccgctttacagcgccgactattcatcaaacggcaaaatcgggctattcggctgtcgaatttgaatgtgaaggcattgtgtgtgagacgggtcttccttataaccaacagtacatcagccttgtaaaccttaaagcgggcaaaattgtccactacaaagattattggaatcctttgactgtcgtcaaatcgttcggaggacagctgcaaacctttttataatctgacaaggagtgatgaaagtgggaaaaaaatattgattaccggcggaaccggtacgacagggagccgaatcgccaaaaggctcgtgcatttgggtgccggcgtccggatcgcaagccggagaatacctgcaattaccggagcagaacatgtatattttgactggaatgatcaaacaacttacaaagacgcattaaaaaacacggactcattgtatttggttgcgcctgtcggtgtatacgaaccgtcgccaatcgtactgccttttttggaaatggcatcggcattcggcgtccgccgcattgtcctgctcagcgctgcaattattgatgaaaatggaccggttttcgggaagcttcatcacgcggtcaggcgatatgttcctgaatgggcggtgctaaagccttcatatttcatgcagaattttgaccatcagcatggcgcttcgattcgggagaaaaatgaaatcgtcaccgcatcaggcgacggcaaagtcgggtttatagatgcagacgatatcgctgaagtagctgtgcgcgcattgcttgatcaaaagccgcataatacgagccatattttgaccgggccggaagccttgagttatgccgaagccgcggcaatcatcggcagagcggcaggccgcgacatcagacatgtcaatgtcgaagtgtccgcgttgagaacaaggtatataaaggcaggattatctcccgattatgccggcttcatgtcggaattagatgagaaaatcaagaacggcaaagaaaaccgcatcacggatacagtggaacgcatcacgggaaaaaaaccgcgttcactggctgatttcgctaatgaacacaccggacgctggcgtctgttttaactcgttcctgaagctgaacggtcttttctcttcatttttgaccgttcagtccaattaataaaatgtttcgtttatttcccatgactcaactgtacagtaggccaagtgagggttcattcccatgcccattaaataagccattgccgctacttcttccatggcatggtgataggaagtggcttgggcttcatttaaaccgtaatgaacaaaaggtgctactgtgcacaacgtcttatgtttcaagtggggaaacaacggacatttaatgtggtgcaaggcggtttcgggatgctgatactgggggatatgcgtatgctgttcgggaaccgccgtctgctgtaaatgttctgcattctccatttctttcgtcctttctcgtgcggattttcgttgtattctatgttccgcttatgccctgtgtgttagacagttgtcacggtttgataggcaaataataagacagaaaggtcaaataccggtagacttttaagcaggataaaaaaaggaggtattttttatggctaaacatcatttttaccttcaggcagactggcctggaaaacgaaacgacatcggaaggattgaaagcgggaatttaaaaaccgaaatttcgataccaaaggaaatggacggcccgggggcggggacaaaccctgacgaaatgctgctcggtgccgctgcgacttgctatatcattacacttgcagcgatgatggaaagaagcggattggaaaaagagagcctgacgatggaatccgaggccgttgtcgatgtgacaggcggggtgtttacgtacgaaaaaatcattcacagacctctgatccgcctcccgaaagaagcggcgcaaaaagaggccgaacttgccgaaagactggctaaaaaagcggagacatcatgcatgatatcaagggcggttcagggcaacgtcgccattgaattagagccgaagattgtcgtctccaaagcggattagatttcgatcgtgagctgagccttttgatccgctgcttcggtgcgctttgaattgagcagaaagacgccgccgatgatcaaagtaagcccaataagagttttgagattaaatggctcctgaaatataaaatgcccgattgcagctgtcaaggccgttccggtgccggcccaagtcgcataagccgctgataaaggcagtgtttttaatgaaaagctcagaaatgtaaaagaagccgcaaaaccgattatcacgccggctgcgggcaggggggcgctaaagccttctgacagcttcagcatcgtgcttccgaatacttcggacaaaatggcagccgccaaaaagatcatgcctttcatgacattcgcctccttatgacaaattgatcagtacaacgcctgacacgagacagataatgccggcgatatttcgccggttcagcttttcttgaaaccacaagacgccgatgattgcagtcagaacggtgcccgctccgctccaagtcgcataggagaggcttaatggaatgacctgcaatgtgagcgacatcatgtaaaatgcgagaccgtagccgattactacaagaaccgacggctgccagcgcgcgaacccgtcagatattttcagcatggcggctgccgccgcttctgacaagatggcgatcagaagaaaaatgtagcctgcaatcatacggaatcctcctctatcgattttattgcatgattcaaaaggagagctttctcttcgtcagccagcagttccaattgaaacattcccgaaagccagatgcgccggatacgagtttgacatatgcaaaggccgggggggcaaactccgcagcgccctctgcgcgcgcttgtacaaagttgaacggtagttttcattcgaatatcataaagcgcagcccataaacgattttaaagtgtttcagcttttattccgaaatcgttatgagcttcttcaaagctttccccttttttagacataaaaaaaaccccgcttcactaaccggttggtaaaatccatcttaattgatgcaaaagttctaagtcaagaaaaaagtaatgtaaaaaggcccctgaaagagcctttatctgtcagaaataaggatagtaaggatacggcggatacggatatccccaagggccgagaagcgctccggcagtaaggccgcccaaaaatcctccgaagaaggggcccggaccgaaaaatggacgcgggccgaaaaacggccgcccaaaaggtccgccaaagaaaggcctgccaatgattcgctggctgtcgtcgtcatatacaggagcatggtcgaaatgatacataaaaaaatccctccaataataaaatgatacctgactaacatcactgtattctgcccagccgtttttgcctgggcgcccgccggattttttagtgaagcagccctcaaaaaggagtgaacgaaaacatgacgctgtatcagtcggattggtcaaaagcgcctccccatgcccacgcctacagggcgagaacaacgactgccgagggacattaccacctaattgagggtttttcccagccggcaaacgggagcaatacagatgggcacgttcatttttattccggaattacttctttcgtcgatggtcattaccataggtattatgcgattacggggccagcgattccgcgggcggacggcacgcactatcatgaaatcgagggcacgacctatttggcatattctgcggctcccccggtcagatatggcggagtcgtttatgtaagcgatggaatgaaggaaaggcaccggcatccttttaagggttacacaagagaaatcgtcggaaatgagccgattggctggtgagggaatgtttggaaaacagtgaaaacgggtaaaatgaaatgggtgtttttgaatgtgaaatggtataatgggaggagcttgtttaaagagagtgatcatcagtgaataaaacgaagccgccggtcatcgttttgatcggaccgaccgctgtcggtaaaacaaaattaagcgtcatgctggccgagcgtttgaacgcggaaattatcagcggagactcaatgcagatttacaaaagaatggatatcggcacagcaaaaatcagagaagaggaaatgaacggggttccgcatcatctgatcgatattaaagaaccgacggaatctttctcggtagctgaatatcaggagatcgtcagacaaaaaattgcagagattgacaggcgagggaagcttccgatgattgtcgggggaaccgggctctatatccagtctgtcctttacgactattcattcacagaggaagcaggcgatcctgagttccgggcggagatggaggcgttctctgcgaagaggggggccgaatatgttcacgatcttttgaaagaacgcgatcccgaagcggcaagagccattcatccaaataataaacgaagggtcatcagggcgcttgaaatcctgcatacaacaggaaaaacgatgtccgaacatatggaaggacagcggaaagagcttttatacacgacggctctcatcggtttgacgatggagcgggaagtgctctatgacaggatcaacagccgcgttgaccagatgatggatgaggggctgctggatgaagtgaaactgctttatgatgaaaacgtaagaaactgccagtctgtccaggcgatcggctacaaagagctttatgcgcatctcgaaggcagagcgtccttggaagaggcggttgagacattgaagcggaattcgagacgctacgccaaaaggcagctgacatggtttagaaatcaaatggatgtcgcatggtttgacatgacgccccctgtcaatatcgagcagaaaaaacaggaaattttcacttacatagcaggaaagctcgaactttaatcgaaacaatatggtatagagaaacaaggaggaccagaaacatgaaatcgataaatattcaagatcagtttttgaatcagattcggaaagaaaatacatttgtcacggtctttttactgaatggatttcagctgcgcggacaagtaaaaggatttgacaactttacagtgttgattgaatcggaaggaaagcagcagctcatatacaaacacgccatttctacgtttgcaccgcaaaaaaacgttcagctcgaactggaatagcgattcacggactaaaagaccatgccttgcatggttttttcagattgcctgacaaaatcctgaaacaggttactgttttgggatttttcgttttcaaagcgactttacaatcacctgcggccgttgccggtctttcagaggaaaaaaactttggcaacctgtctaaaacgccgccgtcatcacgtcctgtgaaagtccgaggcattcaaatttacaaagcggcatctagtcgctaaactaagtagtgtttacatcaattcagtttgaaaatgaaaaggaatgagcgaacaatgaaacctaagatcgtcatcaaccattgggaagagacgtgtgaagatgattcctgctatgaatacggcacaagtattctcgtaaacggaaaagagcttgtcagggaagcgtcgatcatgacggctgttcagtcggttcttaaggaactcggcatcgaagccgatattaaagaggtatgcgagaacaagtgctgtgacgcttacaaaaaataagcgaaaaagtctagtctactaactcaatttttttcgtgttatgatagatttcggtttgtgagtaggatgagcgaacggctctcattctactcatatttctttggcctaaggcctcctaagctgaagcgaattgtgaactttcatcaactcgagcacaatatattgtgttttcttgaatgatagtatactatatattgtgtaaggttcgagtggaagactcggaaacaattttactaggtcgtgataatgatgattcagatcgtatttgattcaaaaacgggaaacgttcagcgctttgtggataagacgccttttcgcaataaacggaaagtcagcacagaggagtatctagacgaaccgtttgttttgatcacgtacacgacagggtttggggaagttccgaaaacgactgagatgtttcttgagaaaaacgcccatcttcttttgggagttgcggcaagcggaaacagagtgtggggagacaattttgcgaaaagcgcagaaaaaatctcgaagcagtatcaggttccgattctcggcaaatttgagctcagcgggacggccaaagacgttgaactgtttactcaggaggtagaaagagttgtcacaaaatcaagtgccaaaatggatccagttaaacaatgagatcatgatccaaaaagacgggaaattccagtttgataaagataaagaagctgtacatagttattttgtagactatatcaaccaaaatacggtatttttccatgatctgaaagagaaaatcgattacttaatcaagaatgactactatgaagaagagtttttaagccgctacacgtttgaagaaatcaaagaagtgttcaaagaggcttacgccaaaaaattcagattcccgtcctttatgagcgcttttaagttttacaatgattatgcgctgaagacaaacgacaagaaaaaaattcttgaacgctatgaagacagaatctctatcgtagctttattttttgcaaacggggataaggagaaggcgaaggaattcgtcagaatgatgatcaaccaggagtatcagccgagcacgccgacgttcttaaatgccggccgcaaacgccgcggagagctggtcagctgtttcctcttggaagtcaatgattccttgaacgacatttcgagagcgattgacatttcgatgcagctgtcaaagctcggcggaggcgtatctttaaacctttcaaaactgcgtgcgaaaggcgaagcgatcaaagatgtcgaaaacgcgacaaaaggtgtcgtcggcgtgatgaagcttcttgacaacgcattccgctacgctgaccaaatggggcaaagacaaggctcaggcgctgcgtacttaaacattttccaccgcgacatcaacgatttcctcgatacgaagaagatttcggctgacgaggatgtccgggtgaaaacattgtccatcggggttgtcattccagataaattcatcgagcttgcaagagaggataaagcggcatacgtcttctatccgcacaccgtttataaagcgtacggcgagcacctcgacgaaatggatatgaacgagatgtacgaccggcttgtggaagatccgcgcgtcaaaaaagaaaaaatccacccgcgcaagatgctcgaaaagcttgcgatgttaagatcggaatccgggtatccgtacattatgttccaggacaacgtcaacaacgtgcatgcgaacaatcatatttcaaaagttaaattttccaacctttgctcggaggttctgcaggcttcacaagtttcatcatacacagactacggtcaagaagatgagatcggccttgacatctcctgcaaccttggttcattgaacattttgaacgtcatgaaaaacaaatcgctcgagcagacagttaagcttgcaaccgattcgctgacgcacgtttctgaaacgacaaacattacaaacgcaccggctgtcaaaaaagcgaacaaagcgatgaaatccatcgggctcggagcgatgaacctgcacggattcttggcacagaacaatatcgcctacgaaagtgaggaagcgagggacttcgcgaacactttctttatgatgatgaacttctactcgattgaacgatccgccgaaatcgccaaagaaaaaggtgagacgtaccatgggtacgaaggttcagcttacgcaacgggtgaatacttcgaaaagtatgttacacaagatttctcgcctaaattcgaaaaagtggccaagctttttgaaggcatgcacatcccgacaaaagaagactggaagcagctgaaacagtttgtcaaagaacacggattgtaccacagctaccggctgtgcatcgcaccgaccggatccatttcatatgtacagtcaagcacagcatcggttatgccgatcatggagcggattgaagaaagaacatacggcaactccaagacgtattatccaatgcctggacttgcgccgagcaactggttctactataaggaagcgtatgatatggacatgttcagggttgtcgacatgatctcgacgattcagcagcacgttgaccaaggcataagctttacattgttcctgaaagatacaatgacgacacgcgatttgaaccggatcgatctttatgcccaccataaaggaatcaaaacactttactatgcaagaacgaaggatacagggcaagaaggctgcctttcttgtgtcgtttgattaaaggagagtatgcgaaagtgacgaaaatttacgatgcagcaaactggtcaaagcatgaagatgattttacccaaatgttttacaaccaaaatgtaaagcagttttggcttccggaagagattgcgcttaatggagatcttctgacatggaagtacttgggtaaaaatgaacaggacacatacatgaaggtgctcgcggggctgacgcttctcgatacagagcaggggaacacgggaatgccccttgttgctgagcatgtggaagggcatcagcgcaaagcggtgctgaatttcatggcgatgatggaaaacgcggtccacgccaagtcctattcaaacattttcatgacgctggccccgacagagacgatcaacgaagtctttgaatgggtcaaacaaaacaaatacctgcagaaaaaagctcagatcattgtcgggctctatgaaaaaatccgccagggcgataaaatctcgctgtttaaagcgatggtcgcatccgtttatttagaaagcttcctgttctacagcggcttctactacccgctttatttttacggacagggcaagctgatgcaaagcggcgaaatcatcaacctgatcttgcgtgatgaagcgattcacggcgtctatgtcggcctgctcgctcaggagatttacaatcagcagacgccggagaaaaaagaagagctgtatgcattttccattgatctattgaaagagctttatgaaaatgagcttgaatatacagaagacctgtacgatcaagtcggcctttcacacgacgtgaagaagttcatccgctacaatgccaacaaagcgctgatgaaccttggctttgaagcttattttgaagaagaagagatcaatccgatcgtgttgaacgggttgaatacgaaaacgaagtcacacgacttcttctcaatgaaagggaacggctacaaaaaagcaacagttgaaccgttaaaagacgacgacttttactttgacgataagtaagccgggctaaaagggcgcgccagcgcccaagccctgcccttcagctattgatacacggcaaaatgagagcagaacgaatctgctcttttcactttgaggaggaaacggatacaatgggaaaaatggacgaaatgattctcgtggtcccgcgggaaaacgtatttgcaaatgaaacgctgaccttccaaggcgtcaacagcgacggtgagacgatcgggaagatcatggcgcatattgaacgccacttcagtgaaatgagaaggggagacgccgaggaagatcctgcatttaaacagccgatcccttatgttgtcatcaaaagagaagacgaaatatttgtatatgagcggctcgaaggcggaggggaagcgcggcttcacaacaagctgtcactcggcttcggcggacacatgaactttgccgaagggcttgactttcccgatattctgaagttgaatacagaccgcgaacttgatgaagagcttctaatcgaggaatcagctaaagaaaaaatggtgacgctcggactgattaatgatgatgaaaacagcgtcgggaaagtacatatcggaatcctttcagcgcttgaattaaaaccgggcgcacacgttgaagtcaaagaaaaggagcagattgccggccgttggatgaaagccagtgatctgaaagaaaaaagcgtctatgacagacttgaatcttggtcacagtttgtcgttgatatcttagtttaaattggaaaactcgctgatcagcgagttttcttttcgtatagaaccggtttccattgaaaaaatgagccatgcttttcgatcagcccgaagccgggatatgggaaatgacagccgtggagcaggaactgtccgttataagcctgtcgggccagcagtctccttgtcttttctccctcgataggatcatgctcaagcgaaacccgcagcttcggattggagatactttccggaatatgaaatacatcattgatgatctgacagacgccgtcttttgtatgcaattcaatggtcaggtgtccaggcgtatgtccgggcgtatggatcagcttcagtccgggaagcagttcggtgtcttctgtcagcagcttcagaagcggccggacagcggagagaatgtgaaactgaggagacgccggcgtttgttttgcgtacagccattctgcttcactgagcagatgaacagcgtttggaaaagcgggctctccgttttttagaagacctcccgtgtgatctaaatgactgtgtgacaaaatgacatagtctatcgagtcaggcttgattcccgcctgcttcaggtgatgaagcaagtgcccgctttcttgtccgcctgtttccccaaatcccgtatcaatcagtatccgtttgccgttcgtctccagacaggcaaagttcagcgctgcttcaaattcttcaggataacgttctgtttccttggagtctcctcccgccaaaaaaaaatcccttgaaacccgaaatgctccatcagataaaattgtcatttgaaaagactcgagctgcatgcggtatggctccttcatgataaatccttcccccttgtgtttgaccgagctgcctttgaaaaggcagcttcattgtgtcttttcatttgcgatgagatttttgatcggttattattaaatcgtaattattatgatttaatagcggaagtataactgaatccgtttattctttcaatcaaaatatactgtttaaaaggaaaggagcatgattttatgccgacactggaagagctgtatcggtccgtcattatggatcatgcaagatacaggcgaaattttcgaaaaatcgataaacacggcgtgtattacgtccattacaaaaatccaacatgcggtgatgtgatgactttgtttatcgacattaaaaatgaaaagatcgaagacgcagcttttatcggagatgggtgcagcatcagcatggcttcctcatcaatcatgactgaactgataaaaggaaagacgttaaaagaagccgggttaatgcgtgaagcgatggaaaatatgatcagaaaaggagaagagccggaagaggatctgctgggagatgccgtttccctgattggcgtccatccgttgcgggcccgtcataactgtgccctgatgccttggcaggcgctcgatcggatcaaagagaacgtttattaaatgaacatcacatctaaagcactccggttctaaagccaccggcaaagaatatcggaagattcaagggaaaaaaggggcagtaacgaaagaggtatggaaaacgaaacgaatgtaaagcaggaagcaatggcgcagcttaaacggaaaggcattcgaatgacaccgcagcggctggctatctaccattattttctagccaacaggaaccaccccacaatagctgaaattcaacaatcattgagggagatatatcctgccgtcagtacagcgacgatatacaacaccatccgctattttaaacaagagggccttataaaagaaatggggtttaccgatccgcttcgttttgatttggctctagaggaacatgatcatgtcatatgcgaagtatgcgggaagatcgtcgattttcattgtccgcaactagagaaagtaaaagacattgcggcacggctgaccggatttaaagtgacacatcaccgattggaactgtacggcatctgcaacgattgccaggcgaaaagaaaatacgccgctaaagagaaaggggttagataaaaaatttgcttgtgcgaaaaaccaaaaaccgatatattggttttatgatgaagaataacattaaacgaatcaaacgaatttcgcttcgggaagaagtgtatcaaacgctgaagcgcgccatcgtacatttggagctaaagccggaggagcgcctgcatgaccaggagcttgcagagcagtttggcatcagccgcacacctgtcagggaggcgctcaaacgactggaagatgaaggccttgttgaagctgtcccgggatcggcaacacgtgtagcaccgttaaatcgcgaggaggctgaacacgcttttacagtcactgcggcgctgcatgcgctggctgtcagactgtcgcttccttttttaacggattccgactttgatcagctggaggcgcataacaaaacgttgcagcaagcgattcaaaaagaagacattatcgaagcaatcgaatcagatgctgcttttcatgacgtgtttttacaagcatcaaaaaacccggaaataacccgggcattggaaaggatttcttcaaaaatttaccgccttgaaatgtcgcagttttcctcgatcggcagcttgaaatctgttgaacagcatcagaacatcatcgatgcctgcagacagggggatcggaatgcggccatcaagcttgccgaggaaaactggctcagtctcggagatcgattggccggacatcaggaaaaggagtgaagggattgtgaggccgattatactgggcgtttttgcagccttcttttttgcttttacattcgttttaaacagggcgatggagcttgaagggggaagctggatctggagcgcttcgctgagatttatcttcatggcgcctcttttatttgccatcgtttggcttagggggaatgtgaaagagctttttcaggaaattaaaaaagcgccgggcatttgggtgagatggagcatcatcggcttcggtctcttttatgcgccgctctgttttgcggcggcttacggaccgggctggctgatcgcgggaacatggcaaatcacgatcatttccggttccctcttggcgccgcttttttatgaaaccgttcaaacaaaaacaggtcccgtacagataagaggcaaaattccttataaggggctcacgatgtcgttcatcattttaatcggggtggcgctgatgcaagctgagcacgcggcacagctttctttgcacgagatgctgctgtgcatcgcgccggttatattggcttcatttgcttatccgcttgggaacagaaaaatgatggaagtttgcgccgggcgcctcgatgcttatcagcgggtattggggatgacgctggcaagccttccgttttggctgatcctctcgctgtacgggctggcatcggcaggtgcgcccagccggggacaagtcattcagtcaggattggtggctgtattttccggaatatgcgcgactgtgctgttctttgccgcaacagatcttgtaaaaggggatatgcgcaaattagcggctgttgaggccacacaatcgtttgaagtgctgtttgcggccgctggtgaaattttaatcctatcgagtccgcttcccggtgccatctcatggagcggaatggctcttgtgattatcggaatggtgttgaacagccatgcatcgaatcaaaagccggcggttcaaagtaaagctgcaaaagcataaaaaaagcctgcgatctatacgagaagatgtgtgccgggttttttgtctaaagaaatgaaagataaaaaaacagccctgttttaaacagagctgttttttgcaaaggtcagctgacgttctttaatttgtcctccggcaaagcgataaaaaatgtcacaatgtaaccgatcactgcgccgataacagccggaacgacccagccgacacccatgctgaacagcgggatgttcgcttttaagatatcgttaaccggccccagcgggattttcgccgcgtttaatccgtcgatgatgctcagaattcctgtcgggataagggcgccgatatagacctcgcgccgttcattaaacagcttatcaatgaatgagagcaaaacgacgacgatcgcaagcggataaatcgcagacagaatcggtactgaaaacgagatgatttctgtcagtccgaaattggcaatcacaaggctgaaaagcgtcacaatgatgacaactgctttgtaagagagcttcggaatcagatttgaaaaatactctccgcaagaagaaacaagtcctacgcttgtcgtcaggcaggcgaacaagatcgcgatgccgagcacggcatttccaagcgagccgaacaaatatgcggaagctttggacaatatttcgccgccgttgtcgagcgaaccgacggtttcaacgcttgtcgcccctaaataagcgagtgaaacgtaaacgagtccgagaccgactgcagcgactatccccgctttgatgcatgaagcggcgattgactttggatttgtgactccgcggtctttaattgccgtaatgacgacaattccaaaaacaattgaagcgatcgcatccatcgttttatacccttctaaaaatccgacaaacagcggtgcggattggtaagcctctgtcacagacccgatgctgcccatcggggtgataaacgctttgatgactaagattgcgattacagtcaataatatcggtgttaaaattttaccgatgcggtcaacaagcttgcttgggtttaacgccaagaaataagtgatcccgaaaaagatcagggtaaagatgaacagataaagacttgacgaatgttttcctaaaaacggctcaaccgctatgacgtatgaaacgtttcccgtcctcggaatggcaaataaaggtccgatcgttaaataaatgctgacgattaatatcgtgccgaagaccgggtgggctttgtcagctaggccttttgcactcccttttaaagcaaccgcgatgacgccgagcagaggaagaccaacgcccgtcagcaagaatccgatgatagccggccaaatattctctccggcagcttgaccaagctggggaggaaaaatcatatttcccgctccgaaaaagagggcgaacagcataagcccaatcgccgtcgtttccttagcggatagtgaagttttcattaaaaagaacctcctggcattttgtttaaattttctgtcaatttattttcgtgatataatatgacaaaagtccaaagactattatattttaaaaatcagagaagtcaaacatttatttttaattttcaattacaagttgatatgataacatatacagtcatgaaaaagaacgttcattttaaaggagtagatcatgatttatcttgataatagttcaacaacaaaaccatatcctgaattattacaaatttatgaacaagtaaatcagcgcttcttcggcaacccgtcgtctctgcaccgccacggcgttgaagcggatcaattgctttctgaagcgcggaaacagattaaatcggcgctttcgctaaaaaatcatgatatcgtgtttacgtccggcgcttcagaagccaataacatggcgcttaaaggcattgctttggcacatgcgcaaaaaggaaagcatatcattgcttcctccattgaacacccgtctgtgacggaatccttggagcagctgaagacggccttcggctttgaggttacatatcttcctgtcgacggccatggctttgtttctcttgaagacttgaaacaagcgctccgcaaagacacgattcttgtaagcatcatgcacgtcaacaatgaaacaggcgtcatccagcctctggaagaaatcgggaaaatcgtaaaagaaaacacaagggcatactttcacgttgatcatgttcagggcatcaacaaggttccgctggacatctccggggcagccattgacctttgtacaatctcgggtcacaaatttcacggcttaaagggaacaggagccctcattctaaacgaacggatctcgctttttcctttgatttccggaggagaacagcagaacaacaggcgtgctggaactgaaaataccgccggcgccgttacacttgcaaaagcgatcaatttgtcaaaacaggattataaccattatatagaagaaataaaggcggcaaaatcagcttttatcaaggagctaaaagagctgaaaggtgttatattaaatacgccggaagaaaacagcgcgccgcatatcatcaatttttccgttccgggattgaaggctgaggtccttttgcatatgctagaggagcgggatattttcgtatcgacgacatcagcatgctcttcaaaacagcataagccgagcaaggtgcttttagaaatgggaaaaggtgaaggtgcggcctcaagcagcatcagaatcagcatgacgtaccgggataatcatgagattgtcggcccgtttatgacggccttaaaagaaagtttacacaaactaaaaggaattatgaggtagaggcacaatgaatgaggactacattttaatcagatttggcgaaatttcaacaaaaggaaagaatagaaagctttttgtcgatcgcctgaaaagaaatatcaaaatggtcttgcgcgatttccgcaacgtccgttatgaatcaacacgcgacagaatgactctcgtattaaacggagaagacgctgaagctgtaatggctcgtctgaaacacgttttcggcatccaatcgttcagtcttgccgtgaagtgccggacagatctggaaagcattaaagagacggcactcgcttctgttcaagaacaatacaagcccggggatacctttaaagtatcgacgaaaagggcttataagcagtttgaattaaatacaaatgagatgaatgccgagatcggaggacacattttgcgcaacaccgacgatcttaccgttgacgtccactccccggacatccatttgcgtatcgaaattcgggaagatgccacgtatttgacattccgggatgaaaaaggtgcgggcggactgccggtcggaagcggaggaaaagcgatgcttatgatatccggcggaatcgacagccctgttgccgggttctatgccatgaagcgcggacttgagatcgaagccgttcactttttcagcccgccatatacaagcgagcgggccaagcaaaaagtgatcgatcttactaagcggcttacggcttttggcggagacatcaagcttcatatcgttccgtttacaaaaactcaagagctcattcaaaagcagattcccgagaactattccatgacggcgaccagaaggctgatgctccagatcgccgacaaactgcgcgaacgccataacgcgcttgcgatctttacaggggaaagcctcggccaggtggcaagccagacgcttgaaagcatgtatgccatcaacgcggtcacgagcacgccggttttgcgccctttaatcggcatggataagacggaaatcatcgaaaaagcgaaggaaatcgatacgtacgatatcagcatacgtccgtacgaagactgctgcacgatctttacgccttctgcgccgaaaacgcgtccgaaaaaagagaaaatcgaacactttgaaagctacacagatttcgaaccgcttatcaacgaagctgtggaaaacacggaaacgattgttttgagcagcaaagcggaaacgaaagatcaatttgcggattttttctaaaggaatattcaatcaaacatctttgtctgtttttgcatacaattaccaaacattctttgtatgaagtcatgtgtttttacacaatctatactcacaaggaggtgagaacacatggctcaaaacaacagacaaagcagttctaaccaactattggttcctggtgctgctcaagctatcgaccaaatgaaattcgaaatcgcttctgaatttggcgttaaccttggagcagaaactacttctcgtgcaaacggttcagttggaggagaaatcactaagcgtttagtttctttcgctcaacagcaaatgggtggaacacaacaataattaaaattaaaaagcaatggataatgggtggggtttaatccccactcttttttatgttctgcaaaataggcatttcggaatacaattgtatgaaaggattatgtataataaaaagatggcacaagacaaggagatggaagggttgagaagagaagatttgattgcgccggagaagtataatgcggttgatgaaattgaaaaatttaaatcttcccgcgataagaccgcattgatctgggaagatgaatcagggcgtcaagtgtcatggtcctatgaaaaattgattgaaaaggcttacaaaatcggcagcatattgacccgttctggactgaaaaaaggtgacaagcttatcgtgatgatgccgcggataccggaaacgtatgccgtgtacatggccattttaaaagctggaatggtggtcatcccatgttccgaaatgcttcgggcgaaagacttggattacaggatcaagcatgcaggcgtcaaaggagcagtcgtatattcagcatttcttgatgcttttctagatgttcgttcaaaagaggcactgtcgttatttgccgtcggagaaagcagcgaagggtggatcaatctgctcgaaaaaatgaatcaggccattgcaacggattttcaagcggcggatacctctcgcgatgacatcgcatttttatcttacacatccggcacgaccggtcagccaaaaggggttgtacatacacacggctgggcttatgctcacttaagaacgacagcttccgcatggcttgacatttcggaaggggatctcgtctgggcgacagcagggccgggctggcaaaaatgggtatggagcccgtttttagcagtgctcggtagcggtgcaaccggctttatctatcatggaaaattcacgccggaaacgtatttgcggctgattgagcgccatcaagtcaatgtgctgtgctgtacgccgacagagtaccggttcatggcgaaagtcaatgatttgtcccgatttgacctgtcttctctgcacagcgctgtttcggccggagagccgttgaacagggaagtcatcgatacatttaaaaagcattttcatattgctgtgcgggacggatacggacaaacggagagcacgctgttggtggggattttaaaaggtatgaaaatcaagcctggaagcatgggaaaaccgacgcctggaaacttggttgatattattgacgggaatggaaagagctgtcccccgggcgaaacaggcgatattgccgttcacttaagcacgccggctctttttaaagaatattacaaagatcaagaacgaacgctccgacaaagaagaggggattactttataacaggggataaggcgcgaaaggatgaagacggctatttttggtttgaaagccgcaatgacgatgtgatcatcagctcaggatatacaatcggcccgtttgaagttgaagatgcgctgatcaagcatcctgaggtcaaagaatgtgctgttgtggcaagccctgatgaaatcaggggatcgatcgtgaaagcatacgttgtcttaaaggacccatcccgcggaaatgaacacctgacaaaggaattacaagaccatgtaaaagccatgacggccccttataaatacccccgggagatagaattcatcgaagaactgccgaaaacgccttcggcgaaaatcaagcgctttgaactaagacaacgggaaatcgcacttaaaacgaaagctgaataaccacacaaagaggagggaatatccgttgggtcatgactcactccgaaacatagagaaagaaatcgcgcttttggtccgtctgacgacggcctacagcccgcgctttggaagtctggaccgctcggaatatctgctgttaagcgagcttgataagcaaagtcctctcgccatcaactcgctggctgaaaccttaatgctgaatctgtcgacagcaagcagacaagtttcagccttggaacggaaaaagctcatcagacgttttcctgatcccaacaacggccggatcagccttgtggagatgacttcggagggcattgatgctctgaaaaaagtgcaaaaggcccgctatcatgtatacacggaggttcttcaagactggacaacagaagaactgaacacgttggaaacccatttgatcagactgaatcaggattttaaaaagtggagcaaataagcggctaaaggctggttggtcagacgatcatcagccttttctttttctttcggttgatttattgcgggaaggatgtataatttaacttgcataatacaacttgtaatatgaaatatataactaaaggaggagcgcttatgagtcaatctgatgtggcgatcccgagctctaaaaaaatcggcattccgaagtatttgatcatttcggttttaacgatactggccattgggccgcaatattttcttaatctttcctatacgctcagtcaagtcgtcattcaaaacggacttcatttgtcaccggacgatatgcggattccgtccattttgacaaatcttgcttttgctctcggtgttccgcttggacgtatattttcaaggaggttcggcattcggaacagctacctgacactcatcaccttatttttatgcggctcgctgatcgacgcattttcagcaggcttgttttcgcttcttatcggaagggtgatacaaggattatgctccggaatgttatttttgacgattcttcctgtcaaattgatttcgtttccgaacaaggtccgcaatttgtttttgtttttcgtcattagcggattgttcggcgcttctgccatcggagcggtttttggttccctgtcactcagcgcggatgcatggcgctgggtgtttatattaaatatttgttcgcctgtcctttgccttgtgatcggcttcttttctttgccgaaacaagcagcggatgagcgggagcatcattcgattgataagacgggcgtttttatgctctcattgctcatggttgttttgacggtgccgcttatcaatttgcagaagacgggtgttcattctttttatgtgtggccgttctttttggccggattcatcattttggcgttgtttgtcattacagacttgcgcgcccgggaacctcttgtgccgtttcgttcactgtggtccgcaaaagctgtttccgggacagtcatggccgttgcttcacacattgcaatcattgtttcccttgccgggataaacggatttttggaaaacattgcagaggcttcttttgaaagcatgacacgcttttatttgtgttttttcgcagggattttagctactgccgtgctcagcacgcttttgtatgatcattttggcgccggattgctcggctgtatcggcgctttggaaatgatatcgtcggtatggaatggagatcggttcaacccggtgtttcgatggagtcgttatatcttcatgctgttttgctgggcagcggcgtcagcatggtattggtatcgggagcgctgggcacggcgcttgccggagatattcaccaagcttcaaaacgctcggtttcgcttcactttatccgcaatttcgccggtgcctgggctgcaccggtgatcggctggtttgcttcaatgaagaatgcggtgcactacgagatgataagaggacatatcagtgaagctgatcctgaaattcagctggaattgtcaaaaatgattcgtgattttgtcagcagcgggctttctgttggtgatgcgaagaacatggcggcctatacgattgttgcaaatgccagaaaagcttcagcccttggcgcatatcacgatttgtttacgatactgctctggctaagcatcatcatgcttgcggcttcaattggaaaggcagcgaccggaaaaggaagatcgctcgttcagaagcgccttcgcctgccagacccttcagcaagtcaacaaaaggagataggataaacatgagtaaaggacgtttgatgatcatcaatatgattggtattatcgcaactttagcgcttgtcgctgtatgcggatattactattatcaaaataaacattatgtcacgacggatgaagcaagggtttccgcaaatatgacaaaaataacggcgcctgcttccggaaaattaagcggctgggatgcaaaagaaggcgaccatatatcagacggcgacaacctcggaaaaatatcggacgggcagcagtcggtagctgtcaaagccatttccgacggaacactggtcaaaaatacagccgtcaatcataaaatcgtaaatgcgggggttgtcatcggtcaaactgccgatatggataacatatatattacggctcatattaaagaaacggaattacgcgatatcgaaaaagacgacaaagtggacatcaaagtcgacggggaccctgatacaacgaagggaaggtcgaagagatcggatatgcgacagattcggtattttcaatgtttccggaaatgaaccaaagcggagactatacgaaagtcaccgagaaagttcaagtcaagatttcgattcaaaatccgtccgccaaattgcttcccggcatgaatgcggaagtgaaaatttcgttataggcattcgcaaaaaagagcaagacgatcgtcttgctcttttttaatgaaaaggttttcaaaattatagaaatgtgcgccttactttttcccagaacgaattatcttttaatttaatggttttgatcatcttgccggagaggctgacttcgacttctttcacattcatcgtactgaaggcttcgttatcaaggccgatgatcggatagtcgttcccgtcctggacgatttttaatgtcagctttcgatccgcgcttaaaataaacggcgagccgagggttctgtatgtgttgttgttcaatgaagcgagctctgtcacctgtatgcatggaatcagcggatcaacgattgccccatcaaccgatttgttataagcggtgcttccggtcggagcggacacgatcattccgtccccccggaatgtttcaaaatgaagatcatctatatagacgtccattacaaatgttttaataatgcttgaacggatggatacttcatttagacattgaaagctggtcccgtcaacggttacatcgatcagaggatattttctgacctcgatttgctccgagtttgtcgcttcaatcattttatcggtatcatatatattaaaatccgcatacaaatgagctttcccctttttggccacgcctacgtacaggcagtcatccctgaagttcgtctttcgaacagcctgcaaaaatgtcccgtcgccgccgatgcttgcgataatattggcttcattgtgatggtgaacgacgcgaaatccgtgttcttcggcaagcggtttcagttttttgcactgctcgtcggtttcttcgctttttttgtaaaagaaataaatgtttcggcggtctgtcacaatcattctcccctttgtctgttaagtttagatttttctgccatctaacatatatgttaaaatgacctgtgacccttagtttaccatgtccaaaaacttcttgtatatgaagcggcatcataatgaactttttctcttcatatacgtactaagacatgcagcttttttattcaaaggaggagaacagacaaaatgaatgcgaaaagatggatcgcacttgtcatcgcgctgggcgtttttgcgttatctgcggtgatgagccttttgcttgcagtatttgacacgatggggaatgacggaaagatgcagtttggcctcaatgacacccaggaagaaacggtgcttgaacaaggaaacagctcaagaaaaatcgccgttcttgaagtgaacggaacgatttccgacaatggcggcgcttcaggcctgttcagctctgaaggctacaaccacagatcgtttttgcaaatgcttgaaaaagcaaaagacgattctgccgtaaagggcattgttctgcgcgtcaattctccgggtggcggagtatacgagagcgctgagatacataagaagcttgaagagatcaaaaaagatacgaaaaaaccgatttacgtatcaatgggatcgatggctgcgtccggcggctattacatttcaacgcctgccgacaaaatctttgcagcgcctgacacgctgacgggttcactcggggtcatcatggaaagccttaactacagcaagcttgcagagaagcttggattaaaaacggagacgattaaaagcggtgagtttaaagatatcatgtcaccgacgcgcgatatgacgaaaaaagaaagagaaatcatgcagtcaatggtagatgacgcgtacgaagggtttgtagatgttattgccgaagggcgcggcatgtccgaaaatgacgtgaaaaaaattgccgacggacgtgtctatgacggccgccaggcgaaacagaaccatctcattgatgagctcggctattatgaagatgcggtcaaagcgatgaaaaaggaccacaaaaaccttgccggcgcatctgttgtcagctatgaagaatcagccggccttgcctcgctgttttcaatgactgcaaataagatgtttaaaagcgaagctgatttcttaaacattaaagaagcgatttctcaatccggtgcaccgagactcatgtatttatatgccaaataggaggggaccgaaaaaatggatgtgacttatgatggaaaggatcataatgaattatcgccgaatgtcggcgtttccagggaagaatcggccccgcatgtagagcatgcctatgccggtttttggatcaggctgtttgcttttctgcttgacggggttgttatcggcagcatcaacaacttagcggtttcacccgttttcagcctgctgaacctccctaaagaatcagggtttttcaccttttcgctttattcttttgtgacggcggcagtattttttgcttactttgtcctgatgacgaagtatttcggacagacgttgggcaagatggtattcgggctgaaggtcgtgtcgcttgtcccggaaaaagggctgacatgggatgtggtcctgtttagggagtttatcggccgctatatcaacagtttatatattacgtatctcgtagcagcgttttcgcctaagaaacaagggattcacgatttctttgcggacactgcggttatccatgaaaaactgtatcgaaaaaaagactgagagttttaaacccggctgaagactgccgggtttttttattcctttgtatcggcggaattccggctatgtttatttttccagttttcttcctataatgcttagtataagaggaagtgaaatcatgatttacatatggattgcgggagtattcattcttttggcagcattgatgataatgaaaatccgcgtagcgatcgagtatcttcatacagacgatgacgaccggctgaccgtcaaagttcggacggcttttggcattctgcgcattaaaagggagattccggtgattaaaatcaaccaggaggatatgaccgttgatgtgaaagaacagacgaattcggctctgaaaaaagataaaaagaggagaaaaatcggctatcgggaagtgttcgatagtacgaagcaaatcaaaaaattggtggaacagatcatcaatatgcagccgatcatccgccggtttatgaagcggattcacgtcacgaagctcgaatggacctctgtcctcggctttcctgacgcggctttaaccgggattgtcacaggcggcgcctggtccctgaaagccggcacggtggctctcttgcatcagcttttttgctttgacagccagccggaatacgaggtgattccagcctttaacagccgttcctccaaaacgcatctgacatgtatattccattttcgggttggacatgctataaccgcagctttcagaatcgtggtgaactggaaagggaaaatgcgcggcttatttaagctgccaaaaaatctgtcaggttcaacaaagaatgattcatcagtataggaggaatagaatatggctgaacatccaattcaaggtttgatgaaaaccgcaatggaaaacttaaaagaaatgattgatgtcaataccattatcggagatcctgtggaaacacctgacggcagcgtcatcctaaccgtctccagagtgggattcggctttgcggctggcggaagcgagttcggcggcaataaaccggccgaatccaaagcgagcgatggagaccgcgaacgaaaagaatcgaagctcccgtttggcgggggaagcggaggaggcgtatcgattacgccgattgcttttttgattgtcggatcatcaggcgttaaagtactgcatttggatgaaaacacgcacgtcatcgataagattttagactcagctccgcaaacgatcgaacggattcagcatatgtttaagaaaaacgataagcagaagcaaaatatgaaccgtcaaaaccagacgcctcctttttaaaagccccggctttccggcaacagagtcccagaagttaactgttcctgcagcagttaactttttttgtctctgccggacttaagctttgcagtttgtcctaaactcttttatagtagagtcatacataaatgaaggaggaatgatgatggcttcaattacatttaagggaaacccggtgacactggtgggttcagaagtgaaagtcggagaccaggcgcctgatttcacggttttgtccaattcgcttgaggaagtcacacttcaggacatcaaaggcaaaccggcggttatttcggtgattccgtctatcgatacaggtgtttgtgacgcacagacccgccgctttaacgaagaagccgcaggcctcggttcggtgaaagtgtatacgatcagcgctgacctgccgtttgcacaggcgcgctggtgcggagcaaacggaattgaaaatgtggaaacattgtcagatcacagggagatgtcttttggggaagcattcggggtttacattaaagaattgagattgcttgcccgcgccgtatttgttttagatgaaaacggaaaagttgtctacactgaatacgtcagcgaagcgacaaaccatccggactacgacaaagccatcgaagctgccaaatcactcgttaagtaaattcaactcataaaagggctccaggtgttcatcttgccggagctcttttcatggctttgattttttgataaggagagacatcatcatgcaaaactatccagtcgaaacgatttatgaatggcttgacaaaggagcggaagtcatcgcacgcgatcggcagatcccttacatagaaggattggcggaagccggagaggcattctttacaggttctgcggaccgcgggctttccgaagaagccgaacaaaaggtgaaggatctgatcggccgtgcgcgcttttcagagtgcagtcatgagtcgatacggaaagccttccagcttgccatactgaaaggccagaaagatattcctcatccgaacaggcagatgacgcccgatacgatcggattatttatcggatatcttgtgaacaaatttatggagcggaaaaaaggattgacgctgtttgatccggcggtcggcactggaaacctgctgcttgccgttttgaaccagctggctgaggaagcgggaaaagcgttcggctcagagattgatgacgtcctgatcaagctggcctatgtccaggcaaacctgcaggaaaaggaaatcgagctttttaaccaggacagcctgcagccgatttttatggaacatgccgatgcggtcatctgcgatcttcctgtcggatattatcctgatgacgaaagtgcgcgcgctttcgaattaaaggcagatgaaggccactctttttcacaccatttgtttattgaacaaagcttgacctatacgaaaccgggcggctatttattttttatgattccgaaccatttgtttgaaagcggtcaaagcgaaaagctgcgtacctttttaaagaacaatgcgcatattaatgcagtgcttcagcttccgctgtccattttcaaagatgaagcacacgcgaagagcattttggttttacaaaagcatggggaacaggcgaaagcgcctaaacaggttctgctcgcgcaagtcccgtcattcgccaatcaggatgcgatgctgaacatgacagccaaactcgacagctggttccaggctgaaaaaagataagcagatcagagaagatatattctctgatctatttttatattcagaaaataataatttcttagtgaaagcgttaacatgtcggatcgtgacttgaaatgcactcttttgagtgtttaaatgagaaaggcagatattttttgaatttactaagaacgattttatacatattttttatgttccgggttgaacataatgtcaccggactataggtaaaaaggagcgtcattttatgtccaaaattattgcaatcaatgctggaagctcatcactgaaatttcaactgttcgaaatgcccagcgaaaaagtattaacaaaaggccttgttgagcgaatcgggctggataacggcatcttcacgatttccgtcaacgacgaaaaaaagactgaaacaacagatattccggatcattccgtagctgtaaaaatgctgctggataaactgacaaaattcggcattatcaaggatttaaatgaaatcgacggaatcggtcaccgcgtcgtacacggcggcgaaaagttcagcgactccgttttattgacggatgaaatgatccatgagatcgaagagatttcagagcttgcaccgcttcataacccggccaatattgtcggaattaaagcgtttaaagaagttcttccgaatgttcctgccgtggccgtttttgatacggcattccatcaaacgatgccggaacaatcttatctgtacagtctgccatatgaatattatgagaaattcggcatccgtaaatacggtttccatggtacatctcataaatatgtgactgaacgcgcggcagagctgcttggccgtccgattgaagaacttcgcctgatttcctgccaccttggaaacggagcgagcatcgcagctgttgaaggcggcaaatcaatcgatacatcaatgggcttcacaccgcttgcaggtgtagcgatgggtacgcgttcaggtaacatcgatcctgcgcttatcccgttcattatggaaaaaacgggtcaaacagccgacgaagtcctgaacacgctcaataagaagagcggtcttttgggtatttctggattctcaagcgatttgcgcgatatcgttgaagcaactaaagaaggcaatgaacgtgcggaaacagcactcgaagtattcgcaagcagaattcataaatacatcggttcttatgcagcgcgaatgagcggagtagacgcgattattttcactgccggcatcggggaaaacagcgttgaagtcagagagcgcgttcttcatggtttggaattcatgggcgtctattgggaccctgccttgaataacgtccgcggaaaagaagcgtttatcagctacccgcattcgcctgtaaaagtcatcgtcattccgacgaatgaagaagtaatgattgcaagagacgtcgtcagactggcacactaaaaataaaaaaacagccttctcttttcaaggagggctgtttttttatacattttcccctttataatgaaaaaagactgtataaaggaggctgtatggccatgagtgttgaagagcataaaaaagaagcgccggactgcgtcaactgcaaagtcattaccgtcagcgatacaagaacggaagacacggataaaagcggccggctcatgaaagagtttttagcggaagccggtcatgagatcgtttcctatgagattgtaaaggacgaaaaggaaataattcaaaaagctgtgctgaaaggctgtctcgacgaccggatcgatgccgtcctattaaacggagggactggcattgcctcaagagatgtaacaatcgagtcgatcgttcctcttttttcgaaagaaattccggggttcggggagatattccgcatgctgagttatacagaggatatcggagcggctgcgatcctctcaagggctgcagcaggtgttattcaaaacaaagccgtatttgcaacaccgggttcaagcggtgccgtaaagcttgcaatgtcaaagctgattgtgcctgagcttgcccatgtcatcagagaactgagaaaagatatgaaaaagtaaggccggaaagccttccggccgaacgctgaatatgcactgaacttcattcataaaaaatgaatgaagttttttttataaaaaggttgaaaaaacaagacttccttgttaaagtgtatacatattaaatgtatttttattaaataaaacttatttttatacaaaagagcaccgagatgagaggagtttttcgaaatgacgcaaaagaaaaaagtggtattagcatattcaggaggacttgatacttctgtcgcgataaagtggcttcaggaacagggatatgatgtagtggcctgctgccttgacgtcggagagggaaaggatctcgcctttgttcagcaaaaagcgcttcaagtcggagcctctaattcttatgttatcgatgcaaaagaagaatttgcgaaagagtttgcgctgaccgccctccaggcccacacgctttatgaaggaaagtatccgctcgtatcagccctgtccagaccgctgatcgccaaaaagctcgtcgaagtggctgagaaagaaaacgcgcaagccgtggctcacggctgcacaggcaaagggaatgaccaagtgcgcttcgaggtgtcgattaaatcgctcaatccggatttggaggtgctggcacctgtgcgcgaatggaaatggtctcgcgacgaagagatcgcgtatgcagaaaagcatggcattccaattccgatcaatcttgacagcccgtattcaatcgaccagaacctgtggggcagaagcaatgaatgcggagtcctagaagatccttgggccgcgcctcctgaaggagcgtatgatttgacgaagcctcttgaaaaaacaccggatactcctgatgtgatcgaaatcgcttttgaagaaggcgttcccgtatccattgacgggactcactacccgctgtcagacttgattttaaagctgaatgaactggcgggcgcacatggagtggggcgcatcgaccatgttgaaaaccgccttgtcggcatcaaatcgcgcgaagtttacgaatgcccgggcgcgatgactttgattaaggcgcacaaggagcttgaagatttgacattggtaaaagaagtggcgcatttcaaacctataatcgaacaaaaaatggctgaagtgatctataacggcctctggttttctccgcttaaagacgcgctttccggtttcctgaaagaaacgcagaagcatgtcacgggcgtcgtccgcgtcaagctgtttaaaggccatgcgatcgttgaagggcgtaagtccgaatactccctgtatgatgaaaagcttgcgacgtatacaaaagacgatgcattcgatcatcacgctgcagtcggctttatcgagctgtggggactgccgacgaaagtaaacagcatcgtccaaaaaaaggagcagattaaagcatgaaaaagctgtggggaggccggttccaaaaaacaccggaaaaatgggtcgatgagttcggcgcatcgatccactttgacaaaacgcttgtaaaagaagatatcgcagggtctctcgctcatgcttccatgcttgaaaaatgcggcattttaaccgaagcagaagcggtcaaaataaaggaaggcctgacatcccttttgcacaaagcggaaaaaaacgaactcgatttttcagtcgattgcgaagatattcacctcaacctagaaaaaatgctcattgatgaaatcgggccgctcggcggaaagcttcatacggccagaagccgaaacgaccaggtggcgacggatatgcacctgtatttaaaagggcacactgagcatatcatcgagctgattacggcttttcaacacgttatgatcgaaaaagcggaagaacacgtggagacgatactgccgggatacacccatttgcagcgggcccagccgatctcgttcgcgcatcatttgctggcttacttctggatgctggagcgcgataaagaacgctatcatgattcattcaagcggattaacaagtctcctctcggatgcggggcgctcgccggaacgacgtttccgatcgaccgtgaatattccgcagacctgctcggctttgattcgatatatgaaaacagcctggacggcgtcagcgacagggatttcatccttgaatttttaagcgcgagcagcattctgatgatgcatctgtcaagattctccgaagaaatcattctttggtgctcgcaggaatttaaattcattgagcttgatgacacctacgcgacgggaagcagcatgatgccgcaaaagaaaaacccggacatggcggagctcatccgcgggaaaacaggacgcgtatacggtgatctgatcggactcctcacgattatgaaggggctcccgttagcatacaataaagatttgcaggaagacaaagaaggtatgtttgatactgtgaaaacggtcgaaggaagccttgagatttttgccggcatgattaaaacgatgacagtgaacaaaaatatgatgaaaaaagcaacggagcaggatttttcaaatgcaactgaacttgccgactatctggcgaaaaagggcatgcccttcagagaagcgcacgaagtcgtcggaagacttgtcttcacctgcatcgaaaagggcatttatctcagcggcctgccgtttgaagagttcaaaaaggcaagcgggctgtttgaagaagacgtctacatcgtgctcgacccgcaccatgccgtcgaaaaaagaatgagcgaaggcgggacgggattcaaaaaggtgacagaagccattcaaaaggcgaagcagtgtttgaacaatttttaacacttcccgattcgattcataactgtgcggcttcatacgcaaaataaatttgtgaatcgaaaaggggtgtggcaatgaaacaagatcagtcaaaacacggatatatgtatgatgccgacggagataaagaaaccgttcagcagatctctgatgcttatttcagcgggtttgtcgcgcacgatgacgcacagccgttagctgacgcagataaacaatagaaagctggagcccgtaagagcgggcttcagctttcttccgtctgtcgattgtattccagcggcgattgaaacttcccgatgctccaaatgtgatatcctaagggttttgtagtaaagtataggtagattaatgcaatcatttgcgaataccgagaaccaatgcctgggagggaaagatgtgcgccatgcgttaattactgccggttcaaaaggtttggggcgtaaagtgacggaagccctgcttgaaaaaggctactcagtgacggtgaattacaggcaagacgaagaagctgtccgccgcctcaaagaaaaatggcggtcatcccttgaccgtttgcagtttgttaagggtgatgtcaccaggaaagaagacctgctccggatggtgaatgccgctcttgagcgatttggaaaaattgatcttctgatcaataatgccggcccatacatatttgaacgaaaaaagcttgcggattatactgatgatgaatggtatgacatgcttgaaggcaacttaagctctgtcttccatctgtttaaagcggttgttccgatcatgaggtgccagcggttcggccgaatcatcacttacggatttcagggggccgaccatgcgcctggctggctgcatcgttccgcttttggagcggcaaaagtagggctggcttctttaacaaagacgatcgccattgaagaagcgggctccggcatcacagccaacatggtctgtccaggcaacattgtcggggatatgaaagaggcctcgatttcagaagcgagggcgtcacttgatgaggaaacgccgatcggcaggtcgggaaccggtgaagacatcgcaaggatcatcacttttctatgcgatgaacattccgactacattacgggaacagtcattgaagccacaggcggcttgaatgtgattaaccgtcattctctctagacgtgcgaaattaaaaaaatcaggggtggatatgatgaaagtggcatatcatggtcattcagtggtaacagttgatacgggagatcatcagttgatcttcgatccgtttattacaggaaactcattaaccgatttaaagcccgaagatgtcaaagcggacgtcatcttgctgactcacggacataacgatcatgtcggcgataccatcgaaatcgccaagcgaaacaattcgctcgttgtagctccgaatgaactcgcggtctatctaggatggaaaggcctgaatgtacatccgatgcacatcggcggctcccaccagttcgattttggaaaagtcaagctgacgcaggctttccacggatcggcttatacggaagaagacagccaaaagatcgtctataccggcatgccggcggggatccttctgactgtggaaggaaggacgatttttcatgccggcgacaccgggcttttctcagatatgaagctgatcggtgaattaaatcatatcgaccttgccttcttgccgatcggcgataattttacgatgggccctgaggacgccaaactggccgcagaatggctcagagcgaaacaggttgtcccggttcactactcgacgttccccgtcatcgaacaggatccgcatgcatttgcggacagccttcctggaggcgtcggaaaagtgcttgaggtcggtgagtcaatcgaatttaagtaaatttgttttagagggcccgaatccgggtccttttttcggttgaaccggttatgcgcctatcaaaacatgtccaccatgatataatgtaggaatcggattcatcttggagggtgattatgagggtattgaaatacgcgattttggggctccttgatcatgggagtttaagcggctacgatatgacaagccggtttaaagccgaattgggccaattttggagcgccaagcacagccagatttatcccgagctgaaaaagctgacggatgaaggatttatcgaatttgaaacggtgatccaaggctcaaaattagaaaagaaaatgtattccatcacagaagccggaaagcgtgaacttcacgggtggcttacggaatttaagccggttccagatacggtaaaagatgaatttatgctgaaagcttattttatctcttcgatggaacctgatgaagcgaaaaggctttttaacgatcagcttcaaaagagacaggaaaaagctgcttttttaaacaccaagctcgatgaattgaagcgcgaagcgggtgattcaataacgttccgctcgcctcatttcggccattaccttgtattgacccgggcgcttgagcgggaaaaaggctattgctcatggcttgaaaaagcgcttctcctgatggaggatgataaggcttaggcgggcatgatgttgtgaaggcggattgcggttcaatcgcacaacgatttataataaatatatctagcagtcagaggatgaaggtgaaacgattggcgacaaaacacgaacagattttaaaatatattgattctttgtctgtcggcgaaaaaatctccgtcaggcggattgccaaagaaatgaaagtcagtgaaggaactgcttacagagcgataaaagaagccgagaataaagggtttgtcagcacgattgaaagggtcggaacgatcaggatcgagcaaaagaaaaaagagaatattgaaaaactgacatatgctgaagtggtgaatgtcattgacggccatgtgcttggcggaaaagcagggcttcataaaacgctcaacaaattcgtcatcggagcgatgaagcttgatgcgatgatgagatataccggagcgggcaacctgctgattgtcggcaaccgaatcgatgcgcaccgccaggctttggaagcgggtgctgccgtactggtgacgggcggttttgatacggagccggagattattgagcttgccgacaggctcgagctcccggtcatttctacaagctatgatacgtttactgtagcggcgatgatcaacagggcgatttatgaccagctcatcaaaaaagaagtcgtgcttgttgaggatattttgactcctttagaaaaaacagtctgcttatcacctcatgaaaagctggaaagatggtatgagaaaaactttgaaactgggcacggacgctttcccatcgttgacgagcagatgaaaatccacggcattttaacttcgaaggacgttgccggatatgaccgcagtgtattgattgaaaaagtcatgacgaaaaacccgattacagtgatcggaaaaacgtctgttgcttcagccgcgcagatgatggtctgggaagggatcgaagtgcttcccgtcgttgacgagcggcaaaagctgatcggcatgatcagcaggcaggatgtattaaaggcgcttcaaatgatccaaaaacagccgcaggtcggagaaaaactcgatgacatcgtgaccggcggtttcaaagaatcggaccatgacaaaaacaagccggctccggtctatcaatacgaagtaacgccgcaaatgacaaaccacttggggacgatttcctacggcgtgtttacgacgattttgaccgaagctgcaaaccgctttttgcggtcgcgcaaaaaaggcgagctcgtgatagagagcatgacgatttattttttaaagcctgtgcaaatggagtctgtcattgaaataaaaccgaacattctcgaagccgggagaaagttcgggaaaatggatatagaagtttttcaccagggtgctctagtcggcaaagcgatgatgatggttcagctgatggaaagaagctaagggacgcggtcggtgtccctcttttcgcttatgcgttctcccgttcgttttctttcgcaagcaaagggacatagtgcttataggccttgtagccggcccacatgctcccgagcccggtcagcataaaaataacgccgatgacgacagccagcgtgccgcggtttaaaatcagctgattggcgccgaagaacatgataaacaggcccagactcatgcttgacttggccgaatagtattcccgttcaaccgcttttttggtgcgcacataccttactttgaagtacacataagctatcgctgaaaccacaataaaaaaaacaaaaaacggcataatcgacatcctccattgtaagttttacaaacccattgtatacataatcgggttcgctttctacaataaaaagtcataactttcactttccaccaacaacagattatgatttaatggttaaaaacaaagtaaagaaggggcgcgtcatgaaaaaagaaatcatcagaaccatatcattatatgacacgatcattatacatagacatgtgagaccggatcctgacgcctacggatcccaatgcggccttacggaaatcctgagggcaacctaccccgaaaaaaatattttcgcggtcggagctcctgaaccttctctcgcttttttgtataccccagatgtgattgaagacccggtgtatgaaaatgcacttgtcatcgtttgcgacacggcaaatcaagcgagaatttcagattcgcgctacaacctgggcgacaagctgatcaaaatcgaccaccatccgaatgaagaccggtacggcgaccttttatgggtggatacgagtgcgagctcgacgagcgagatgatttacgaactgtacttagcgggtaaagaacaagcgggatgggcgcttccaacaaagggcgccgaactgatctatgccggcattgtgggggatacagggcgcttcttatttccgaacacgacaaaaaagacattgaaatatgccggagagctgatcgagtatcctttttcttcccaggcgctttttgatcaattatatgagacgaaattaaatgttgtgaggctgaatggctatatttaccagaatgtttctctgtccgaaaacggtgttgcgtcggttttcatcacccgcgatattttacatcaatacaatattacgccgtctgaagcttcacagcttgtcagcacgctcggcaatatttcggggatcaaagcatgggtgttttttgtggaggaagccgatcaaatcagggtaaggcttcgttcaaaggggccgattgtcaatgaagtcgctaaaaaatacaacggcgggggccatccgctcgcagccggcgcttccatctatgactggaaagacgctgatcttgtcatcgctgacctggagcgtatatgcaaagaaaacaaataagaggggaagtccctcttttttgtgcagttcaactgcaagcgcttgcattgcatcttgcaaaaaagtaaacagcagcaaagtgtaagcggatcattttacgcacgacagctgctgtttattcaggtataaaccatgatccgatatctgttacatcctcataaacatggatgttttgggcctttaactcttttttgataagggacgcgagactttcagtttccgcataagccgagtagcccagcttgatccggttgactttatctcttgccagctgatggtaactgtaaatgtacattctgctttcctccctttttaaaaaaacttacatatcgcttactgtcagtttaaattaaaatatggaaaaaagcgacgaatgcatgtgaatcgtaaaaaaaaatccataatttttattcggaaaaagagattttgatttcaacggaaagccgcgtataaatcgtcagttcggtgactttcgccttgtactttttatcgtttatcgtatactctttattttcaatcgtccgctttaaaagctccttcgtccggtagacgctttcgatatcctttgtaatgacatctgaaatgttatcccggatatgctcctcaaagttcatcatgtccggctgtgacagcttgtattgcttgccgttgatcagcttgacgtcgacgctttgaatcagcagttttcttttattgtcttcattcagcttatgcagatcctcgcggtaaatggtgatctggtcatttaaatcattgatgcgctctttctgttccctgatcaagacgacctgcttctcctgaaaggttccgtatgtaaacaggaacacgaaccagctgatgatggctccgcacatcattcccgcaaaaaaacgctgccacccaggctttttataatatggagggattctcatgaggaaatatgctcctgtgtgagccagttgatgatcagataaccggtctgcgctcctcccatcgccgaaagaatcaggagaagctgttttacgatgtctctcgtattgccttcgataatgcccctttcaaagctgtagaccgcatcaaacgtgccgccgattgccgcaaccagcgcccagattttcaggcggtttgcgagacttgtaatgatcgttaaaggcggctgccccgacagataggcgccgatccccccgattaaacaaccgccgagaagcactccaagcgcaataaaataacagctgataaagtttgggaaaaagggctgttcaggatccattccgatcacctcaccttatcacactatatggataaagaaagacaagtatgattgttgatcaaagaaagaacatttgtttctcattcgatcccatcatataatgaaaagagacggctcgaaaaaggaaggggtgacagaaatgccttttgttcacctgcaagtacatagcggttacagcttattaaacagcgccgcttccgtagaggatctcacggccaaagccaaagagctgggctacagcgcaatggcgctgacggatgacgaggtcatgtacggggcggtggaattttataaatcatgcaaaaaacgcggcatcaagccgattatcgggctgacggcttctgttttaacagatgaaaaagagcagctatcatatccgctcgttcttttggcgaaaacaaacaaaggctatcaaaacctgctgaaaatcagcagcgtgttgcagtcaaaatcaaaaaccggcatcaaggaaaaatggctcaaaagctatcatgaaggcctcatcgcgctgacaacgggcgggacaagccatgttgaagcgctgttgaaagaagggctgatcgaagaggcgaaggacgctgccctccgctgcctttcgatctttggagagggcagcttctatttgtcgtatcagccgtacaagggagacccgcttctttctgaacgcattttagagctaagcgaacatacgggaattccgattgccgcaaccggcgatgtacgctacatcgaaaaggaggacgcggcagcttacacgtgtttaaaagcgattaaagcgggcgagaagctgaacgaagacatgaaggccgaaggagatctgcatcttgagctcaagccgcccgctgaaatgctggacatttacagagatcgtccggacgcgttggagaatacagtcaaaatcgcggaccgatgccaggtggacctgagccttggccagacgcgcctgccgaaatatccggcgccttccggcaagaatgccgacgattatttggccgagctttgctttctcggactgaaaaaacggttcgaagccgctccgaaggagtatgtcgagcggcttaagtatgagctgaaagtgattcgcgacatggctttcagcgactattttttgatcgtctgggatttcatgaagttcgcccacgataacggcattatcacagggccggggcgcggatcggcggccggttctctcgtcgcttatacgctgtttatcacagatgtcgatccgcttaagcacaaattgctgtttgaacggtttttaaatccggagcgcatcagcatgcccgatatcgatatcgattttcccgatacgagaagggatgaagttattcagtacgtgaaaaataagtacggggcactgcacgtagcacaaataaccacgttcggtacattggccgcaaaagcggcgctccgagacgtcggcagggtgatgggcatcagtccgaaagaagccgaccagctggcgaagctgattccctccaaacccggagtgacgctgaaagaggcgagagcactttcacctgaacttgacaagcgcctaaacggctcaaaaaagcttcaggacatatttaaaacggcgcagaaaatcgaagggcttccccggcatacgtccattcatgcggctggcgtcgtattgagcgaggagccgctgacgaatatcataccggtacaggaaggtcatggcggcgtatatttaacgcaatattcgatgggctatctcgaagacttgggacttttgaaaatggattttctcggcttgcgcaatttaacgctcattgaatcgatcaaaacgctgatcgaaaaaagcgagcgggtcactatcgatttctcggcgattccctatgatgatgaacagacgtttaagctgctggctgaaggagacacgacaggtattttccagctcgaatcagccggcatgagaaacgttttaaaaaggctcaagccatcgagccttgaagatattgtcgccgtcaatgccttgtaccgcccgggcccgatggaaaacatcccgctgtatatcgaaaggaagcacggacgggttcctgtgtcttatccgcacgaggatttggccgatatcctgaaagatacgtacggcgtgatcgtttatcaggaacaaatcatgatgatcgcatcccggatggcgggtttcaggcttggagaagccgaccttttgcgaagggcggtcggcaaaaaaaacaaggaaattctcgatacagagagaaatcattttattagtggatgtttgaaaaaaggatattccgtacaggcggctaatgaagtatacgatctgattgtgaaattcgccaattacggttttaaccggagccatgccgttgcatacagcatgatcggctaccagctcgcttatttaaaagcgcattatcccctctactttatgtgcggcctcttgacgagtgcgatcggaaatgaggaaaagcttgctcagtacatctatgaagcaaaagggaaagggctgaatgttctaggtccttccatcaataagagcggctatccgtttgtcgtggaaaacggggcgctgcgctacagtttaagagctgttaaaggcgtcgggatagcggctgtaaaagagatctacagagccagaaaagaaaagccgttcgcagatttgtttgatttttgtgtgaggacttctgtgaaaagcgtaaatcggaaaacgattgaagccttaatttttgccggagcaatggatgaattcggtgaaaaccgggctactttgctcgcttctgtcgatgtcgcgctggagcatgccgaattgtttgcaggagacaatgatcagctaggcttctttctcgatgaaggcttgacaatcaagccgaagtacgccgagacggaggaaatgccgctcgtcgacctgctggcacacgagaaggaaacgcttggcatttacttttctgaccatccgctgagcgtccaccgcaagaaactggaccgtgcaggtgcgctgccgattattcagctgctcgcctccggccgcaaaaaagcggctctgggcggacttttgacgaggatgaagacgatccgcacaaaaacgggacagacgatggcttttctggagctgagcgatgaaagcggggaaatggaggcggttgtttttcctgaacagttcaggcagctttccccgatcctggaagaaggcgtatcgctttttgcagaaggacgccttgagacaaggaatgaaaaacgccagctgattatttccggggcatcgctcgtcgaatcgcttcatgcgaaaaagcagccgtccgtctatattaaagtggaggaaagccagcacacccacgatattttcaagaagatcagcagcatcctgcttgaacacaaaggggaaacgccggtctgcgtctattatgaaaaacggaagcagacgatgcagctgccggaaagctataatatcaaggctgatcacgctgctctatacaggcttaaaagcgttgtaggtgagaaaaatgtcgtgctcagatagcaggtatcctgagcatttttgatcaaaaatgcggtcagttgtgttatcatttttaagattctggggttcgtcttacaagaatcttaagcagaaaacgaagcaaagtttttggcaaaattcccttgaaggagtgtttgttaacatgtcattgaaagaaaaagcactgcatatgcacaaagtaaaccagggcaaattggaatcaaaatcaaaagtgcaggttcgcaatgcggacgatttaagccttgcatattctccgggtgtggctgaaccctgcaaagcgatttacgatgataacagcaaagtatatgattatacaatgaagggaaacatggtagcagtcgtctcggacggaacggctgtgctcggcctcggcaatatcggccctgaagccgccctccctgtgatggaaggaaaagtggttcttttcaaaagctttgccggtgtggacgctttcccaatctgtttaaatacatctgatgtcgataaaattgttgagacggtcaagctgcttgagccgacattcggcggcgtcaaccttgaagacattgcagctccaaactgttttgtcattgaagaacgcctcaaaaaagaaacgaaaattccggtgtttcacgatgaccagcacggtacagcaatcgtaacggtagccggtctcgtcaatgcgcttaagctgtccggcaaaacgatgtcttccgtcaaagttgtggcgaacggcgccggcgcagcgggaattgccatcattaagcttctttatcatttcggcgtgcgcgacatcatcatgtgcgacacgaaaggcgcgatctacgaaggccgtccgaacggcatgaacgcagttaaagaagaagtcgcaaaatatacgaacaaaaaccgcatagacggttcgctcaaagacgtgatcaaagacgccgatgtctttatcggggtttccgtcgaaggcgctctgacaaaagaaatggttgaaagcatggctgacaaaccgatcatcttcgccatggcgaatccaaatcctgagatcatgcctgccgaagcgcatgaagccggagcaagcgtcgttggaacgggacgctctgacttccctaaccaagtgaacaacgttctcgcttttcctggcatcttccgcggggcgctcgacgtccgcgcgacacatatcaacgaggagatgaaaatcgccgcggttgaggcgatcgcgtcactcgtttccgacgaagagctgagacctgaatatgtcattccggctccgttcgatccaagggtcgcaccagctgttgccaaagcggtagccaaagccgcgatggaaacaggcgttgcacgaatcgatgtcgatccagaagaagtcgctgaaaaaacaagaaagcttgcagtgattgaagggaaataaaagtccatttttgatcagcgcgtgattgctctggcctaaagagccgtcacgcgctgtttatcgaatatgatgttcggtttttcctcttattggggacacttgtaaggaaatattcgggctgtgaaaatttttttcaaatcgcttttccggacttttgtatccgctctcaaggctgatatatcaatttgtcagtctctaaccgcataaagtgcgattcggctgtttgccggtcaaaaatgtcgaattgaggatgacaccgtttgacaaaaaaagtacaatagtttcggtatagtgatgttctagtctataaacaggacaggcatacatgaagaaaacccttcagaaaagggaggtaatcttttgttaaaagatatattcagcaaaaagaaaaaaaaatacgcttccgttcccgcggaatcagcgaagcaagatgtaccggaagggatcatgacaaagtgcccggattgtaaaaaaatcatgctcacaaaagagctggataaaaatttaagggtctgcatgaattgcggttaccatcttcaaatgaacgcgaagcagcgtataaaaagcctgctggacgatggctcctttgaagaattcaatcaggatatgatgtctgaaaacccgctggagttcccgggataccttgaaaaattgcaaaaagaccgggaaaaaacgtcgctgaatgaagcggttgttaccgggaaagggacgattgacggatctccggcggtcgtggccgtgatggattcatctttcagaatgggaagcatgggatctgtcgttggcgaaaaaattacgcttgcaatcgaaaaggcaagagaagaaaaagtacctttcatcatttttaccgcatcaggcggtgcaagaatgcaggaaggccttctcagcttgatgcaaatggctaaaacaagctccgctttgaagctgttcagcgaagagcagggcttgatcatttcagtgatgacgcatccgacaacaggcggcgtatccgcaagcttcgcatccctcggcgattacaaccttgccgaaccgggcgcgctgatcggctttgccggaagaagaattatcgaacaaaccatccgtgaagaactgcccgaggattttcagactgcggaatttctgttaaagcatggccagcttgattccgtcgttcacagagctgacatgaaaaaaacgctcggcagcattttgaaaatgcaccaaactggaggtgatctcgagtggctggagaattagaatttgaaaaaccggtggtcgaactgcgtgaaaagatctccgaattgaaaaagttcacacaggattccgatatggatttgagctctgaaattacgaagcttgaagctcgtcttgaaaggcttgaagaagacatttatacaaatctgaaagcctgggacagagtccagattgcaaggcacccgaaccgtccgacaacgctcgattatatcgaacatctctttaccgatttttttgaatgccacggagatcgttatttcggtgatgatgaagcaattgtcggcggaattgccaagttccggggtcttcctgtgacagtaatcggtcagcagcgcggcaaggatacaaaagaaaacatccgccgcaatttcggaatgccgcatcctgaaggctaccgcaaagcgctcaggctgatgaagcaggccgacaaatttaacaggccgatcatctgctttattgatacaaaaggagcatacccgggcaaagcagctgaagagcgggggcaaagcgaagcgattgccaagaatctttttgaaatggcgggactctccgtgccggtcatctcgatcgtcatcggggaaggcggcagcgggggagcgcttgcgctcggcgtcgcaaaccgcttattgatgctggaaaactcaacttattcggtgatctctcccgagggagctgctgctatcctctggaaggattcaggactcgcgaaaaaagcggcagaaacaatgaaaatcaccgctccggaccttaaagaattggatattatagatcatgttataaaagaagtaagaggcggagcacaccgcgatgtggagcagcaggctgcctacatcgacgaagcgctgaaaggcgagcttaaatccctgctgaaactggataagaacgagctgatccaacaaagatataacaagtataagtcaattggaaaaatttcgactgaaaaccaatatgttgggataaaataaataaacgtgaggcctttggctcacgtttattttttatgggtgaaggtgaaaagtgaaaggattgtgtctgccgcccgcgatttttcaaagagtttgcttaaaatttatttaaaaactttttgtttaattgtataatgagtaaggttttatagggattttcggaaaactttcatccctttttcattgttttagcggcaatgaacgtgttaaggtaaattatatatgttttcgaggtgaaaaagatgaaacgtatcggagtattgacaagcggcggagattccccgggaatgaacgcggcggtccgcgcggttgtcaggaaagcgatctaccatgacgtagaagtatacggaatttacaacgggtattcaggtttaatcagcggaaaaatagaaaagcttgaaatcggttctgtcggagatatcattcaccgcggaggaacgaagctatatacagcaaggtgtcctgagtttaaaacggtagaaggacgggaaaaaggaatagcgaatttaaaaaaatatggtatagaaggattagtcgtcattggcggcgacggttcttatatgggagccaaaaagctcacagaacacggttttccttgtgtgggagtgccgggaacgatcgacaatgacatcccaggcacagatctgacgatcggattcgatacggcgctaaataccgttatcgacgccatcgataaaatcagggatacagctacatcccatgaacgtacatacgtgattgaagtaatgggccgccatgccggggacattgctttatggtcaggtttggccggaggcgcggaatccattttgattcctgaagccgactacgatatggaagaaattattgcaaggctgaaaagagggcatgagcgcggcaagaaacacagcatcatcattgtggcggaaggcgtcggcagcggcgttgaattcggaaaaagaattgaagaagccacaaatctcgaaactagagtatcggtgcttggacatatccagcgcggcggttccccgactgcagcagaccgcgtattggcaagccgtctaggggcatttgcggttgaactgcttcttgaaggaaaaggcggacgttgtgtaggaattcaaaataaccagcttgtgcatcatgatatcattgaaatactcgagcaaaaacatacaattgatcaaagcatgtaccgcttgtctcaagaactgtcaatctagtgtaaaacccgaggaggaagcaatatgagaaagactaaaatagtttgtacaattggaccggccagcgaaagtgttgaaaagctcacccagctgatggaagccggaatgaacgtggcgcgcctgaacttttcccatggagatttcgaagagcacggcgcaagaattaaaaacattcgtgaagcagccggcaagctgggaaaagatatcggcatccttcttgacacgaaagggcctgaaatccgcacgcacacaatggaaaacggttcgatcgaactggcagcgggttctcagctgatcgtttcaatggacgaagccatcggtacgcctgataaaatctcagttacatatgatgggttgattcacgatgtgtcagtcggttcaacgattttgcttgacgatggattgatcggacttgaagtcactgacataaacaaggacaagcgtgaaatcgtcacgaaagtgatgaacagcggaacgttgaaaaacaaaaaaggcgtgaatgtgccgggcgtcagcgtcaatcttccgggaattacggaaaaagatgcaaacgacatcgtattcggcatcgagcagggcgttgatttcatcgcggcatcctttgtgcgccgtccgtcggatgtccttgaaatccgcgaacttcttgaagagcacaatgcggcagatattcaaatcattccaaaaatcgaaaaccaggaaggcgttgacaacatcgatgccattcttgaagtatcagacggtctgatggttgcgcgtggagacctgggtgtagaaatccctgccgaagaagtgccgctcgttcaaaaagaactgatcaaaaaatgcaatgcgcttggcaagcctgtcatcacggctacccaaatgctcgacagcatgcagcgcaatccgcgtccgacacgcgcggaagcgagcgacgttgccaatgcgatctttgacggaactgacgcaatcatgctttcaggtgaaacggcagcgggaaattatcctgttgaagccgttcagacgatgcacaatatcgcttcccgttcagaagaagcgctcaaccataaaaaaatcctttccgcacgaagcaagcaagtcagcatgtcaattacggatgcgatcggccaatctgtggcgcatacggcaatcaaccttgatgtgaatgccatcgtcacaccgacggaaagcggccatacggcgagaatgatttccaaatatcgcccgcaggcgccgattgttgcagttacggtaaacgatgcggtgtcaagaaagctgtcacttgtgttcggcgttttcgcaacaagcggacaaaaccacagctccactgacgaaatgcttgaaaaagcggtgcaaaaatcactcgatacaggcatcgtacgccacggcgacttgatcgttatcacggccggagctgtcggtgaagccggtacaacaaacttgatgaaagtgtatgttgtcggagacgtggtcgcaaaaggccagggcatcggacgcaaatccgcatttggtgaagtagtcatcgctcaaaacgcacaagaagcggccaaaaaaatgaaagatggcgccgttttagttacaaaaagcacggatcgtgacatgatggcatcccttgaaaaagcggctgcgctgattacggaagaaggcggcttaacaagccacgcggcagtcgtaggcttaagcctcggcatccctgtcatcgtcggaatggaaaatgcgacttccattctgaaagagggagaagacatcacggtcgactccgcccgcggagctgtatacaaaggacgtgcaagcgtgctttaatcgcttattgaagaagaagggaagctttccccttcttttagatttatgacaaaatcctaaaacgtttttcagttttaggattttgtcatccttcaattcagcgtgattgaaaacccttgcagtctaggaaggccgagcatcggagcggagcgaatgttggaattcgtgagcaccgacgcgcaggcctgacaacgaatgcgagggtttgacaacacgctggaagaagggaagctttcccttctttttttgcaggcggcacaagcaaaatagggcggccgttcgcttccaatttagaattatgaggtgaaaaaaatgaagtttttcttattatttctcgtcatttttccagcgagtgaaatcggtctgttcctcttgtccgctaattggatcggtgtgctgccgaccgttttgctgatcattttgacgggctttctcggggccgctctcgccaaaaaacaaggaatcgaagtctactacaaagtccagcgcgatcttcagtacggaaagatgcctggggccgcgattttggacgggctttgtatgttcatagggggcatgctgcttttgctgcccggttttttatcggatatcatcggtttactgctgctgctgccggcaacgcgcggccgtttcaaaccatttatctcccgcaagctgaagagaatgtctgaaggcaggcggatcaacattatcaaataacccgagataagcggcagcccgcatggaaaagcatgctgccgcttatttttcatttcctttaataaacagccatatgtctctaaaaatacctgttgtaaagagagcctgaataagaacgagaagggcggggcccatgatcaatccgagaaagccaaacaatttgaaaccggcaaacagcgcgattaatgttcccaaagggtgaagtccgattgaccggcttaaaatcttcggttcggcaagctgcctgaagacaagtacgacgatgtacagaattccaaggccgatcgccagcggcagctgcttggccgctgctaaatagacaatccacggcacaaatacagaccctgttcccaaatacggcagcaggtcgaccagcccgatcagaaaagcgatcgccacagcatgattgactttcaacacggaaagcccgatcaacacgagcaccatggtcatcgccacaagggtaagctgggccttcacaaagcctgccagcgcttttttcaattccgcatagacagccgctgcacccgagatcagccgatcaggaagcacagaccgcgccttgttttgtattttatgcagatctttgctgataaaaaaagtggccaggagcgaaaagatcagcacggccgccatattcggcagaaaggcgaaaaagaggggcaccgtctcaagaatttttgaaagcaataaagccgtgcctgaagcgagttcactgcccaaattttggacctgtgtaatgatcgattcctgctgggcggcttcaaggccgtcaaaaaaagcggccagctgattatacagcggcatgatctgatccgtaaaaaacgattcgatataaagagcggctttattaaactggaggggaagtattttagccaaataggccgttccagagacgatctcggcaacgaccagtgtcaaaaagccggctccggcggtcaaaaagccgaacagaacgattccgacattgacgcctctcgggaacccggtcagcttatcgagccattccacaaaaggattgatcatgatggcgagaataagcgcaatcacaaaaggataggttaacggaaaagagtagtagccgaccgctccgcaaacagcggtcaaaaacagcacatacactgcccgaagcgcagctgtaagataggattggttcaattctgcatcctcctgatattagaaagcatgtccttatttcattttattcttaagtcctgttattatgagaaaggtcataaaaaaatggagttgaatacagcatgtttactcaagctaatttatttttgatcctgcttttggccatcgctttaatcgcgaaaaatcagtcgttgatcatcgctgtatccgtcctgcttttgatcaagctgatcggcctcgatcaaaagctgtttccagccatccaatccaaagggatcaactggggcgttaccgttattacaattgcggttcttgtgccgatcgcaacaggagagatcggctttaaacagcttggcgaagcgatgaagtcatattacgcatggatcgcactcggagcgggcattctcgtagcattgatcgccaaaaacgggatcacattgcttgcagaagacccgcatatcacgaccgctcttgtatttggaacgattttagcggtcgctttcttcaaaggcgttgccgtcggcccgctgatcggtgccgggattgcctatcttgtcatgcaggccgtccagcatttcacatcttagaaatgtgcgcgctccccctgtttcagggggtttttttgtttgaaaaaaactttcgctactaaaaaaatttcagccccgtatttttttaaaaaaacataattaaatgtaaataatacagttaaaactactaagaatctgtaaatagaagtcagctgggccaaaaaataagaaaaaaaaactatagttaaacatttaacaaatgtctgataattgtttataatataaatatgcttaatctttattaagcatatcggagtatcgaacggtatatagaaacgcacgattgttttatttgaaaaacgatttaatgtaagcattttctttttggattaaagaagatgtatacgtcatgcgttgtttttgctcctgggttttggtttaattttaaaaggggaaatttttaaaaaaagggagagatgagtatgacagcaacacgcggccttgaaggggtagtcgccactacatcatcagtaagttcaattattgatgatactcttacatatgtagggtataacatcgatgatttgacagaaaaagctagctttgaagaagttgtttatctgctttggcatttaaagctgccgaacaaagaggagcttgccgagcttaaaaaacagctttctgaaaatgccggcatccccaaagaagtcattgaccatttcaaatcctacccgaatggaaaagtccacccgatggcagctcttcggacagccgtttctttactcgggctgtttgacgaagaagcagatcaaatggatgcggaagcaaactacagaaaagcggtgcgtctccaagcgaagatgcctgcgcttgtcgctgctttttcaagaatccgcaaagggcttgagccgatcgagccgaatccggaactcggctttgcagccaactttctctacatgctgaatggaaaagaaccttcacctgtcgaagtggaagcgtttgacaaagctttgatccttcatgcggatcatgagctgaacgcatctacgttcacagccagagtatgcgtcgcgacgctttcagacgtttactcagggataacggccgcaatcggagccttgaaaggtccgcttcacggcggagcaaacgaagcagttatgaaaatgctttcagagattggcgaggttgaaaacgtagattcatatatccacgccaagcttgaaaagaaagaaaagatcatggggttcggccaccgcgtataccgccagggcgatccccgcgcaaaacatttgaaggaaatgagcaggcgtttgacgaatttaacgggtgaaagcaaatggtatgagatttcagagcggactgaggaaatcgtcacgtctcagaaaaagctgccgccaaacgtagacttttattctgcgtcggtttatcatagcttaggaatcgaccatgatctgtttacgccgatttttgcgatcagcagggtatcaggctggctcgctcacattcttgaacagtatgaaaataaccgcctgattcgtccgcgggctgactacaccggccctgacatgcagacgttcattccgattgaagaaagaagctgaccgtttgaaaagaggctgctcgagcttcgttcggccggcctctcaacggcttttctatggaagcaatgaattaatgaatctatgaaaaaacatgtttgtcccccgccaaacgggggaaacaaatgtttttctatattgaagaattacatattatgggaggttttattgtggcacaaggcgaaaaaattacagtctccggcggagtattaaacgttccaaacaacccggtcatcccgtttattgaaggggacggaacaggtcctgatatttggagagcggcttccagggttcttgaagcggctgtggagaaagcgtataacggcgaaaagaaaatcacttggaaagaagtctacgccggggaaaaagcgtacaacaaaaccggcgaatggcttccggaagaaacgcttgatacgatccgcgaatacctgatcgcgattaaaggtcctttaacaactcctgtaggcgggggaatccgctcattaaacgtagcgctcagacaagagcttgacttgtttacatgcctgcgtcctgtccgctatttcacaggcgttccttcaccggttaagcgccctgaagatacggacatggtcatcttccgtgagaatactgaagatatctacgccggcatcgagtatgcgaaaggctctgaagaagtgcaaaagctgatttcattcctgaaaaacgagcttggcgtcaacaaaatccgcttccctgaaacatcgggcatcggcatcaagccggtttctgaagaaggaacatcaaggcttgtcagagctgcgatcgagtatgcgatcgagcacggccgcaaatctgtgacgctcgtccataaaggaaacatcatgaaattcacggaaggcgcctttaaaaactggggctatgaagtggctgaaaaagaattcggtgataaagtattcacctgggccgaatacgaccgcatcgctgaaaaagacggcaaagacgctgcaaacaaagcgcaaagcgaagctgaagctgccggcaaaatcatcatcaaagacagcatcgccgacatcttcctgcagcagattctgacacgtcctgccgagtttgacgttgtggcgacaatgaacctgaacggggactacatttcagatgcgctggctgcccaagtcggcggaatcggcatcgcacctggagcaaacatcaactatgagacaggacatgccatctttgaggcgacacatggtacagcgcctaaatacgccggcctcgacaaagtaaacccgtcttcagtcatcctatccggcgtgctgcttcttgagcatttgggctggaatgaggcggccgaccttgtcattaaatcaatggagaaaacaatcgcatccaaagtcgtcacatacgatttcgctcgtttgatggacggcgcgactgaagtcaaatgctctgaattcggtgatgagcttatcaaaaacatgtcttaaacggctgttttggggtaaaacaaacaacaattaaaaggggtagaaaaaatgggaaagaagcgaaataaagtatctgtcatcggagcgggttttacaggtgcaacaactgcgtttttaacggctcaaaaagaattggccgacgtcgtattagtcgacattccgcagctcgaaaaccctacaaaagggaaagcgctcgatatgctggaagcgagccctgtccaaggatttgacgcgaatattacaggaacggcaaactatgaagatacggctggttcagatatcgtcgtcatcacggcggggatcgcaagaaagccgggaatgagccgggacgacctcgtggctacaaatgaaaagatcatgaggagcgtaacgaaggaagttgttaaatactcacctgattgtatcatcatcgttctgacaaaccctgtagatgcgatgacatacgccgtctataaagaatcgggcttcccgaaagagcgggtcatcggccagtcgggaattttggatacggcaagattcagaacgtttgtcgctcaggagctcaacctttccgtcaaagacattacaggttttgtactgggcggacacggggacgatatggttccgctcgttcgctactcttatgcaggcggcattccgcttgaaacgcttcttccgaaagaccggatcgatgcgattgttgaaagaacgagaaaaggcgggggagaaattgtcaacctgttaggaaacggaagcgcgtactatgcgccggccgcttccctgacagaaatggttgaagcaatcttaaaagaccagcgccgcgtgctgccgaccattgcctaccttgaaggcgaatacggctatgaaggcatttatctcggcgttccgacgattatcggcggaaacggtcttgaacagatcattgaacttgaactgactgaaaccgaaaaaagtcagctcgataaatccgttgaatcagtcaaaaacgtcatgaaagtattatcataataaacacggcaggaaggctttatacaagccttcctgtttttgaatgcgaaccttttacataagacggtatgaaacaagacataaacacgggctgtcagcatatacctaatcataatcatctgcccggacattttcattctttttgatggaggccgctggctgcatggggattccatcacttaaaacagcggcttatggccgaaaaagagagattttaagcaaaacactgaaaaatcaaattgtcgaacggataggctttcgttaaaataggagtgaaaacgtttatttaacaaaagatagagaaagagatgtcggggaaatctgaagcctggaggcatgtcatgagcaaaaagatattagttgtagatgatgaggaatcgattgttacccttctaaaatataaccttgaacggtcgggctatcatgtggtgaccgccatggacggagaggccggcttattaaaggcgattgaagagaagccggatctgatcgtgctcgatctgatgcttcctaaaatggacggcattgaagtatgcaaggaactcagacagaagaagctgatgtatccgattttgatgctgaccgcaaaggatgatgaatttgataaagtgctcggtctcgagctgggtgccgatgactatatgacaaagccgttcagcccgagagaggtgacggcaagggtcaaagcgattttaagaagaacacagacgctgtccgttcagccggaggagacggaagaaccggatgcaggcgagctgatcataggcgaactgaaaatactgcctgaacattatgaggtttattttcaaaacgaacgcctcgagctgacgccgaaggaattcgaacttctcttatatttgggaaggcataaagggagggtgctgacgagagaccttctcctcaacgctgtctggaactacgacttcgcgggcgatacgcgcatcgtcgatgtccacatcagccaccttcgcgataagatcgaaaaaaatacaaaaaaaccggaatacattaaaacaatcagaggtcttggctacaaaatggaggagccgaaactgaatgattaaattccggacccggcttttagctgccctgctgacgcttttgattctcgtatttgcttcactcggttttctgctcgttcacttgtttcactcctcttacgatgccaaactgagcagccatattgaaaaagaggccgctttggtcgcttcattggcaaatggtgaaaacatgaagtcttcggagcaaggagctattttagagaaggcaagccgtgaactggacagtcgtgtatcgcttattgatacaaaaggtcaggttctttttcattttgggggccgcgccgaagagcaatccgttatcaaggaagcgcttgagtcggatttaaacggtgaaggaggaggcttcaggatcaaccctgatgacgagtccgtttaccgttacgtgcagccgctcaaagatgacgggaatgtgaatggatatattctgatcagcactcctgtcgattcattgcaagacatcaatcaaaagatctggattctcctcggcgtgagccttggaacggcctttttaatcatcgccgggcttggggcgagaataacctctcaatatacgaatccgattgagtctgcgacacaagtggcgattgagcttgccaaaggaaactataaagcaagaacattcaacgaagatgaaacgatgctgagccagtccatcaatatgctggcgcagaacctgcaggacatgacaagagcccaggaaatgcagcgcgaccgtctgcaaaccgtcatcgaaaatatcgattccggtctgatcttaatcgacggaaagggttatattcaccttgtgaaccgcgcttatcaaaagcaatttcacgtagaagccgatcagcttctttaccatttctatcacgaagtgctcgaacacgaagagatcattaatctcattgaagaaatttttatgacggaaacaaaggtccgcaaaatgtttaaactgccgatcaaaattgaaagaaggtattttgaagtcgacggggttccgattatcggcatcaatgatgagtggaaaggcatcgttctcgttttccatgacatgacggaaagaaagcagcttgaagaaatgaggaaggactttgtcgccaatgtctcccatgagctgaaaacgccgattacatcaatcaaagggttcaccgaaacgcttctggacggagcgatgaacgaacgggagacgctgttgcagtttctatcgatcatcttaaaagagagcagccgtctgcaaaccttgatccaggacctgttggatctgtcgaaaatcgaacagcaaaacttcaccctgaatattcaaaattgcaatatcggtgaaatcctcgccgaaattgagatgcttttgaagaataaagcggaggaaaaaggaatcaccttgacactggaaaagccggataagccggccgttgcttccggagacccgcacagactaaagcagatctttttgaatttggtgaacaatgcgctcacatatacgcctgaagatggaagcgtgacgatttcggctgatgttctggaagatgcagtgcaagtcaaagtgagggatacgggcatcgggatcaagcagtccgaaatcccgaggatatttgaacggttctacaggatcgataaagacaggagcagaaattcaggaggaaccggtctcggtcttgcgatcgtcaagcatttagtcgaagcccaccaaggcgaaatcgacgtcgaaagcgagcggggaaaaggcaccgaattcacggtccgcttaaaacgcgcatccgagtagcttcatttagcaaactttacaaaggcttaacaacttttatatatatggttaaaacttggctgataggatcattagtgaaccccttcatccaaggagccatatggacggacgcgatcaacagcgcgtccctttttttatttttctgcgaaatcactctcattttcctttcaaaatgaactttgctaaaataaaataagcaaatatgatcacgaagttgaatggaagctgacgaatcggctccttaggaggataaagatgactgaaagaaaaaaattagtattggttgacggaaacagcctggcttaccgtgcgtttttcgccctgcctcttctcagcaatgaaaaagggatacatacaaacgcggtgtacggttttaccacgatcttaatgaagatgcttgaagaggaaaaaccgacccacatgctcgtcgcttttgatgcggggaaaacgacattcagacataaaacgtttaaagaatataaaggcggcagacaaaaaacgccgccggagctgtcagagcaattgccgtttatccgcgagctgctcgacgcatatagaatctcaaggtatgagcttgaaaactacgaggccgatgatattatcggcacccttgccaaatcagcggaaaaagacggatttgaagtgaagattttttccggcgacaaggacctgacacagctggctacagaaggaacgacggtcgccatcacaaaaaagggcattacagatgtcgaatactatacgcctgaacatgtccgggaaaagtacggacttacccctgaacagatcattgatatgaaagggctgatgggagactcgtcagacaatattccaggcgtgccgggagtcggcgaaaagacggcgatcaagcttttgaaacagttccatacagtagaggagctgctgtcgtcaatagacgaagtcagcggaaaaaaactgaaagaaaagcttgaagaatttaaagaacaggctttgatgagcaaagagcttgcgacgattacgacagaagcgccgcttgaagtcagcctcgattccctcggatatgaaggttttgacagggaagcggtcgtcaagatttttaaagatctcggctttcattctttgctcgaaaggattggcgaagaggcgggagagaaagaagaagaacagttggaagagatcgatgtcatgatcaaaacagacatcacggatgacttgtttgcgtcaccggcttcactcgtagtcgaacagctcggcgacaattatcacgaggcgccgatcctcggtttttcgatcgtcaacgaacacggcgctttcttcattccggaagagacggccgttcagtcggaccgttttaaagaatgggccgaagatgagtcgaaaaagaaatgggtgtttgatgcaaaacgtgcggcggtcgctttgcgctggcggggcattgaactgaaaggcgctgagtttgacgttcttcttgcggcctatatcatcaacccggggcactcctacgatgatgtggcaagcgttgcgaaagaacatcaattacacatcgtttcagcagatgaagcggtctacggaaaaggagcgaaacaggcggttccggatgagaaggagcttgccgaccatttagccagaaaggcgaaggcgatatcgctgctgcgcgaaaagctccttgatgaactggaagaaaacgagcagctcgaactgtttgaagcgctcgaaatgcccctcgcccacattctcggtgagatggaatcgatcggtgtccaagtcgatgtcgacagactgaaaaaaatgggtgaagaactgtccgctaaattagcggaatacgagaaaaaaatccacgagtcagcaggtgaaaccttcaacattaattcaccaaagcagctcggtgtgattttgtttgaaaaactcgggctgcctgtcgtcaaaaaaacaaaaacgggctattcaacttcagccgatgtgcttgaaaagctgcgcgataaacatgtcattatcgaagatatcctgcactacaggcagattggcaagctccagtccacatacgtagaagggcttttgaaagtgatcaaaaaagacagccataaagtgcatacccgctttaatcaagctttaacacagacgggaaggctcagctcaaccgatccgaatctgcaaaatataccgatccgccttgaggagggccgcaaaatccggcaggcgtttgtcccttcgcaaaaaggctggctcatatttgcggcggattactcacagatcgagctgagggttctcgcccacatttcaaaggataaaaatttgattgaagcgttcacgaacgatatggacgttcacacaaaaacggcgatggacgtttttcatgtatcagaagaagaagtcacccctgcgatgagaaggcaggcgaaagcagtcaatttcggaatcgtctacggaatcagcgactacggcttgtcgcaaaacctgggaattacaagaaaggaagcggcagcgtttattgaacgctatttccacagcttccagggagtcaaagaatacatggaagagaccgttcaggaagcgaagcagcgaggctatgtaacgactcttttaagccggaggcggtatataccggaattgacgagccggaatttcaatctgcgcagctttgccgaacggacggcgatgaacacaccgatccagggaagcgccgcagatattattaaaaaagcgatgatcgacatggcggacaagctgaaagaaaaaaatctccaggccaaactgctgctgcaggttcatgacgaattgatttttgaagcgcctgaagatgaaatcaaagtgcttgaaaaactggttccggaagtcatggaacatgcattggagctcgatgttccactgaaagtggactgcgcttcagggccttcatggtacgatgcaaaatagagaaaaggaagtgatgatgtgccggaattaccagaagtcgaaacggtccggcgcactcttgccgggcttgtaagagggaaaacgatcgatgcggttgatgtcagatggacaaaaatcataaaacgtccggaggagcctgaggaattcgcaaggctcctggccggccagacgattcagtcgatcggaagaaggggaaaattcctgttgtttcatcttgatgactgtgtcatggtttcccatttgagaatggaaggaaagtacgggcttcatcaaaacgatgaaccccttgataaacatgtgcacgtcattttcaggttcacggacggaagcgagctgcgctaccgggatgtcagaaagttcggcaccatgcatttgtttaagccgggagaggaactgacagagctgcctctcaggcagctcggccccgagcccttcagcagcgaatttacagccgattacttaagagagcgcctgaagaaaacaaaccgctcggtgaaaaccgcgctgctcgatcagcggacagtcgtcggactgggcaatatttatgtcgacgaggctttgttcagagccggtatccatcccgaggcaacagcgaacaagctcacaaaaaaacagacggttcttctccataaagagatcattcaaacgttaaaggaagctgttgaagcagggggaagcacagtcagatcttacatcaattcacaaggtgagatcggcatgttccagctcaaacttttcgtttacggcaggaaagatgaaccttgtaaaaaatgcggatctccaattgaaaaaacagtcgttggcggaaggggcacgcatttttgcataaagtgccagaaaaaatgacaatcgcatagaaggacaaaagcaagccgtatcatggttcaagctgtcggtgcatacgctccatatagctgttaaaagcaagctttaaggtgtgatgtttctttttcgggtgaacaacacacggatggttttcttctttcatatatataagaagcctagaaagctgcctttaggctgcatgacttacactgctcgcatcaacagaaaggaagagcctgatatgatgtttgcatctttcttgctgctggcatttgccgtcagcttggacagtttttcagtcggatttacttacggattgcgaaagatgaaaatcccatttaaagcgattttgattattgctttttgctctggtgccgtgatgtatattgccatgatgatcggaacccttttggcgaaattcctgcccgttgtcgtaacagaaaggctcggagccgtcatcttaatggggatcggcgcatgggtgctgtatcagtttttcaggccggagaaagaacaggatctcgtcttctctgaaaaaacgctcattaaccttgaattgaaatcgctcggaatcgtgatacacatattaagaaaaccgacaagcgccgacattgataaatcaggaatcattaccggtatagaagctttccttctcggtttcgccctctctattgacgcgttcggcgcagggatcggcgcggccgcgctgggcttttcccctgtaccgatgagcattacggtaggcatcatgagctcattgttcgtattttgcggaatacaggcaggccgatttttatcgaaatggaactggatggataaactgacctttcttcccggtatattgctgattatgatcggcatctggaaactgtaagaaggaggtgcaggcctttgacattggtcatcgggttaaccggggggattgccagcggcaaaagcactgtcgcgcaaatgttccagcagtgcggcatcacggtcgtcgatgcggacgtgatcgcgaaagaggccgttgaacaggggatgcccgcttatcagaaaatcgctgagacatttggtgaaggcgtgctgcttgaaacaggcgatatcgaccggagaaaacttggagaaattgtttttgctaatgaagaaaaaaggctgcagttaaatgcaatcgtccatcccgaagtgagaaaaatgatgatcaagcagcgcgacgaagccatccgggccggtgaacggtttgttgttctcgatattccgcttttatatgaaagcgggctcgaacatttgacagataaagtgatcgttgtctgggttccgatggagcttcagcttgagcggctgatgaaaagaaaccggcttaataaagacgaggcgctgaacagaattcacgcccagcaatctcttgacgaaaaaaagaaaagggcagacgcggtgatcgataacagcggcagtctgaaagatacagaagcgcagcttcatcagctgcttgatacatggtcaaatattgaaaagtgagcgcaatgtcgcgctcacttttttgattagtcttttttaaactggctgtaattcgcatagtacagagcggtgcgctgcgcacctgcgtaccgtttggcaaaagctttggcattgccggccttcatcgtccgatagctgtagttggatgaaggtgtccagcttgtctcaggcgatttctgcccctttatcgccggatatgacccgacatctttaaacgcgccgtctccgtaatcatccagtatgcctttctcattgcccgtgccgaagtaattggcttcagaatatattttcgccaatgtcgtaatcgtgaagccaaggtggtaattgttgatataattgcttttcacgtgataatagccgtaacgcatcaacccgggcgccctgacatagagattctcaaagcgattgtggctgattgtcatccgcggatagccattatatatactgtggtattgcttgtcatcttgaggccagccgagaatcaggccgtacctgtggtctgtgaatgtgctgtgcgacagtgtgacgtaatcggctttagcgccgacgtataagagcttgtcgagatcgtggccgtttgccgtatagctgtggccttggaatgtgacgtggtcaatccagtagtttctcgaatcggtaatgtaaacagggatgtcattgttttcatttatggatgcatcatgtgcaatgaccagatttttgaaaataacgttgccagagtccgcttttgttttaaagtaaatgttattcagcttatgtttttcatacgagccgatgattgttttattggcgcccaccgttaataccgttttggctgaagcgccgatattgctggagacgacaatcgtgcgcggcgttgaatcttcaatattggccttcagttcgcccagattattgacatagacgacttttccaagcaggccgccggttgtgcctgttttctgcttgccgttcgtttcccttgcatagcctgcgaaaccttcgagcccgtcgcttggaagcttccacttttggacggagctgcccgtatatttggcaagcttcactccgctgccgtccagtgtcagtgcaaggctgctgttttgtgcactgacgattttatacgtgataaaatctccgtttccgtctttgtcggccccgatgatattccacaactcttccttccgtgaattgtcatagtagaccacagccggattattgtctgacagtgcgtaatgggcagggatgataattttgccgctatccatatttctgattttgaattgtttgccgtcagacgtatcaagcctccatctttcttctttttctccgctcgtctgttttgctgttagcggtgcgttgtcttgattcccggcgggcgtaatatttaagcctgatgagctttccagcctgatcatctgttccggataatcttcgtttgccgcagaagcagcgactgtacctaataaaaaataaatgccggccgcagccaaaaaagaaatgataaaagatgcgtttttgatcagtttcatggttgtccttccttgaagacactgccttctgtcggtgaaaatttagcgctgttgcaaattgtagcaccaaaggtgtatttgaaatatatgctttagggccgattttttttagtcttttgttcacgatttcacaaaagtgcgtaaatttgctgtgaaagcaacaaatggtatggctaattaaaaataatgtgttatacttattttgaataaatcatgatgtggaatgacataaaataaggggtgcatatttgatgaaagtgaaagttgcgataaacggattcggccgaatcggcagaatggtgtttagaaaagcgatgcttgatgaacagattgacattgcggtgatcaatgcgagctatcctccggaaacgctcgctcatttaataaagtatgacacaaatcacggccgttatgaacttgatgtaaaggctggagacgactgcctgttcgttaacggtaaaaaggtcatgctgaccaatcagagggaccctaagcttcttccatggggacaatacgggatcgacatcgtcgtggaagcgacggggaaattcaactcaaaggaaaaagcggaagcacatattgaagccggcgcgaaaaaagttattttgacggcgccgggcaaaaatgaagacatcacaattgtaatgggtgtcaacgaacgcgattttgatgcggagcgtcatacgattatttcaaacgcttcctgtacgacgaattgtctcgctccagtcgcaaaagtgcttgatgatgcattcggcattgaaaacggcctggtgacaaccgtacacgcttttacaaatgatcaaaaaaatattgataatccgcacaaagacttgaggagggcgcgcgcctgcggatcttcgatcattccgacaacgacaggcgccgcgaaagcgctgtcacttgtcatgccccatttaaagggtagaatgcacggcctggccctgcgcgttcccgtctcaaatgtgtcgctcgttgaccttgtggctgatttgaaaagcgatgtgacgtcggaggatattaatgaggcgttccgcatggcggcggcaggctccatgtccgggatcatcgatgtatgcgatgaaccgctcgtttcatccgattttaatacgaatccatactcggcggtgatcgacagtctttcgacaatggtgcttgaaaacagaaaggtgaaagtgctcgcatggtatgacaatgaatggggatattcgtgcagggttgtcgatttgatcagatacgcggcttcaagaatgaaacacccctcagctgtataaaataagagcatggacggataaaaaaataaataccccttaaccatcaaatgataaaaccgccttgcaaaaaatattcaaacaaagtatactatttttcgtgaacttctagttcgtgagcgcttcggcattacttaaagggttaggacctctccggactaactttcccccgtggtaattgaccggttcagttgcttggaaattcacttttttaattcttgttaaggggggtccatgctatggaaacaatggggcgtcacgttatctccgaactgtggggatgcgattttgataagctgaatgacatggattttattgaaaaaacgtttgtaaatgcggcactgaagtcaggtgctgaggtacgtgaggtagcctttcataagtttgcgcctcaaggtgtaagcggagtcgtgattatttcagaatctcacttgaccattcacagttttcctgaacacggatatgccagcattgatgtttatacttgcggagatttagatccgaacgtagctgccgattatatcgcagaagagttaagagcggaaacaagagagaacattgaaataccgagaggcatgggacctgttcaggtgaaacaggccaaagccaaagcacaggcactttaatgccgatagaggagctggatgaaaaagcggacaccgcttttaaaatccgctcctttttctttcctctcccgaaaatccccaaaccatattccccggcattctcttgctgttttgttttcccttggaaatcaaccatttttttaataaaatatagagaagaaagacaaaggggacaggggatatgagtctttttcaaaacattcaacggtttttttctacacacgccgaaacgtctgaccgccatccttcggaagagctgaagagccgctattataaagcggcgtcaaaagaagcgctcaatgctgtaaaggaagtgctggaaggccttgacggctgcaaggtgacgtcagtgtcggaggaaagaggagaaatcagcgccgaagttaaaaaaacgagaaaagcttttgtggtggcgacagtcgtttcgattcggccttttgatacagcggtggactttaatgtgtcaactgaaacgtttttgccgaccgattttggctacagccgcgggcttgtctcgacgctatacagcgaactggacggaaagctgcaggaatctgtacattcaaacaattgaataggagctgaaaaaatgaaatgtccagcatgtcagcataatgggacgagggttttggactcccgtccggttgacgaaggcagatcgattcgcagaagacgcgaatgcgaatcgtgcaactatcgatttactacatttgaaaaagtggaagaaattccgctcatcgtcgtaaaaaaagaaggaatccgggaagaattcagccgcgagaaaatgctccgcggtttgatcaaagcgtgcgaaaagcgccctgtcgccttgaagcagcttgaggatatttgctttgaaattgaaaaagagcttagaaatcaaggcgtttctgaagtgaaaagcgacatgatcggagaaatggtgatggacaggcttgcgaaaatcgacgaagtcgcatatgtacggtttgcttcagtataccgccaatttaaagatattaacgtatttatcgacgagctgaaagatttaataaagaaagaacggtaaagagctgtaaattgatccagctcttttctcatgacaaaaacacagtcgtgtgacatgaaagcctgaaaaaggtgtaaaatgaggacaagaaacaaagtggaaggttgacaaaagatatgagtaattattggaaagatttgcttcctgtcgatccgtatgttgtcaaaagcagcggattgctgcaggacttggaccggcaaattgtcacgctattgtatcagcctttaatcggctctttttcgttcagcttgtttctcacgctgtggggagagctggagcaaaacagagtctggggaaaaagctcgactcacagacagctgatggcggcgatgcagaccagcctgaagacgattcactcagaaaaggaaaagcttgaggggatcggactgttgaaaacttatataaaagaaacggaacacgaacgtttgtttatatatgaattgattccgccgctcagaccggacgagttctttcaggacggcatgctgaatgtcttcttgtacaaccgcgtcggaaaggcgaggtttcagcagctgaaagaatatttttcccacccgtctgttcctgaagaagcacgggacatcacccgttctttcaatgaagtttttgcatctgtccagccgagcgaatggaagatgtccgacgatatgatcgaagcgatggagcttcgcgaagatcatgaatggatgaaagaagggaatagccaaccggcagcagtcacagacggcgcctttgactttcaactgtttctcgccggtttatctgacacgcttatcccgagaaaagcgctgacagaccaagtaaaggaaacgattaaaaagctggcctttctctacggtatcgaaccgcttcagatgcaaaacgtcgtcatgtcagccgttgacgaacacgatatgatcacgacagaggcgctcagaaaagcggcgagcgactggtatcagatcgagcgcggcggcccgcttccggaactcgtcgacaaagtgcagccgatgaatctccgcgaacagccgaatcaacagtcgtccacaaacgccaaggaagacaatttgatcgctttgcttgagcaagtatcgccaagaaagctgctgcaggatattggcggcggagcggaaccatccaaagccgatctgaaaattatagaagaaattatgcttgaccaaaaattagagcccggcgtcatcaatgttctgatttattatgtcatgctgaaaaccgatatgaagctttcgaaaaattacacgcaaaaaatcgcttcccactgggccagaaaaaaagttcgtacggttagagaggccatgaagcttgcgaaagaagaaaaccgccaatatcttgaatgggcggaagggaagaaaaagacttcccggaacaagaaagtcatcagagaagaaaagctgcctgattggcttcgggaaagtgacgatgctgacagcaaaccgctggaaacagagcaggctggtcctgcaaccagagaaggctttgaccagcagaaacagaagctgctcgaagaagtaaaaaaactgaaaaaccattccgctctttaatgtgaggtgacaagatgatggagccgattaaacgcgctttgcaaggcgtgacgacgagacccgattttaaaaaacgccttgaagatatgaaagaaaaagtgctctctgacaaggatgttcaggcgtttttaaacagccgccagtcagaagtggatcaaggaatgatcgacaggagccttaacaagctttatgaatatacacagcaaagcaaagcatgccaagactgcccgggtctgaaagaatgcaaaaacctgatacagggttatcatccaaagcttgtgctgaacggaaaaacaatcgatgttcaatacgataggtgtccggaaaaaaagaaagcggacgagagggaaagacagaggtcgctgattaaaagcatctatattcaacaggatcttctgaatgctacgtttgccgatattgacggagatgacccgagcagattgaaggtccttcagcttgtgacgggattcttgcatgactataacgaaacgggaaagggaaaaggcatttacgtctacgggaagttcggggtcggaaagacctttatgctggccgccattgcaaatgagcttgccgcaaaggatcatccgtccattctcgtctatgtccctgaatttgtcagggagctgaaaaatgcgatacatgatcagtcgcttgaggaaaagcttgatatggtcaagtctacgccgattctgatgctcgatgacatcggtgcggagtccatgtcaagctgggtgagggatgaggtgctcggcgccatccttcagcacagaatgtcccagcagctgccgacgtttttctcttcaaactttgatcctgatgaactgaaacaccatttcacctattcgcaaaggggagaaaaagaagaagtaaaagcggcaaggctgatggaaagggtgctgtatttagcgacgcctgtccggctggacgggaaaaaccggcgtcagtaatcatttgacaccgagcttcaatcacggagatgaagaagatgcgaaaaagaaccttggccaaatggacggtaatcgccgtaatcgcggcggccggactatggctgaatgcgaaatacctgaatctgagccctgctcatataagagaaggcgtcttatcctttgggattttcgccccgttgatctatatcggactattgatgatccggccgtttttgctgcttcctgcttccgttttcgccgtcagcggcggcctcgcattcggtccgctgtttggctctttgtattcttttatcggtgcggcaggcggtgcatttttatcattcgctcttgcatacaggctcggcggatactttcagcacatgccgctgaagctcgacagcctgcggacgcttttgcggaaaaacggctttttctgcattttgctcttgaggctggcgccgattcattttgacgcggtcagctatgcggcaggcgtttccaaagtgaagcctctgtcgtttgccctggcgacggccgcgggtatcataccgggcaccattattttaaacgtgctcgggtcaagcctcttgaccggcgacatcctagcgattgcggttacagccgcaatttacctgatattcattacagtgccgcttttgttcagaaaaaaagtgcaggcgctcctcgattaagggctcatccttttttacgtctattttatttgtcacccccatatacatgtaacagatgttgttaggggggacaaacatgcttgaaattacatttgaagatgattatgatacagccgcgtttttgcatctccttcgcaatgcggatgcgaatcggcatatcaggattcacgaagcgccagggaagatcggaattgaaaagacccattcctctgtcagtattcaggcctatattgagccggttctgacgagattttttacagaatgcaaagaagatgaatacatgctttcggtcattgaaggcgattattactttttggaccgggatgaacagcagcagattcttcaattggcccacagcattatggagggcgaacttgaagggcttcctctcaacaaggacgacacccctcgcgaacatttcatcattcaggagctccaagcgatctgtcttgaggaaaacgtcttttcgattcggtcatttatgacgtttcgccttgcgaagtattatgaacgcctcagatcttatgtggaggcggcgatcgacgagtataaaatggagcaggaatatcagacattcattcaatcgctgagagactacgtcatgtcgaaagagccgatgcttgaccatgtccacattgtgcacgacggttactttgtattgtgggaattaaagtatatttctgaacgggaacaaaaaaaatacatagacaggcggttcgtaagagaacacccaatgtatattgattcccatctcctggctccgctcgtatcgattgcgccggaaaaaatagacctctatacagaagaccgggaacacgccatggttcagaccattcaaaatatttttcaggagagggtgcggattcttccgcttggcgcctttcatccgcgggaaaacattttggaagagcattcttgattttgcgtgaaaaacaatttataatacggtataaacttaaagatatcatgtattgataaggacatgaaaagatgaacaccggtttgacagagagggagaccatggctgaaagtctcttatgccaaggatcatttttttaccgcctttgaacatcagttgtgaacggcaatttgtctagtaatgactgacgggacttcccgttacagaaccgaaagccgagagcgcgccgggttttttgcgttttcgggaaaaagggtggaaccacgaattccgtttattaatcctcgtccctttcttagggggacggggattttttattttgtaaaaaaaaggagtgactaggatgtcagatatggtaaaaatcaaatttcctgacggagcggttaaggagtttgcaaaagcgacgacaacagaagatatcgcggcatcaatcagtcccggcttaaagaaaaaagcgatagcggggaaattaaacggcaaagaaatcgatctgcgcgcaccgatccttgaggacggcgccatcgaaatcattacagaaggcagcgaagaagcgcttgaaatcatgcgccacagtactgcacacttaatggcccaggcgatcaagcgcctgtataaaaacgtgaagctcggggtcggcccggttatcgaaaacggcttctactacgacgtggatttggaagaagcgctgactccggaagaccttccgaagattgagaaggaaatgaaaaaaatcgtcggggaaaatctgccgatcgtaagaaaagaagtcagccgagaggaagccagagccctgtttgccgaaatcggcgatgatctgaaattggaactgcttgatgcgattccggaaggcgagacggtatcgatctatgagcagggcgaattcttcgatctgtgccgcggtgttcacgttccttcgacgggcaaaatcaaggagttcaagctgctgagccttgcgggggcatactggcgcggagacagcaacaacaagatgctccagcgcatctatgggacggctttcttcaaaaaagccgagcttgaagagcatcttcgcctccttgaggaagcgaaagaacgcgaccacagaaaactcggaaaagaactgaagctgttcgccaattcgcaaaaagtcggccagggtctgccactttggctgccaaagggtgcgaccatcagacgcgtcatcgagcgctatatcgttgacaaagagctcgcgctcggctatgagcacgtgtacacccctgtcctcggcagcaaagacctgtatgaaacatcaggccactgggatcattatcaagacggcatgttcccgccgatggagatggacaatgaaacacttgtgcttcgtccgatgaactgtccgcaccatatgatgatttataaaaacgacattcacagctaccgtgagcttccgatccggatcgccgagctcggaacgatgcaccgctatgaaatgtcaggggctctttcagggctgcagcgcgtccgcggaatgacgctgaatgacgcccacattttcgtccgtccagatcaaatcaaagacgagttcattcgaactgtccgcctgattcaggatgtatacgaagacttcggactggaagagtattcattccgcttgtcttaccgcgaccctgaagatacagagaaatactacgatgacgatgaaatgtggaacaaagcgcaatcgatgctgaaggaggcgatggacgagatcggccatgattattacgaagctgaaggggaagcggccttctacggaccgaagcttgacgttcaggtcaaaacagcaatcggcaaagaggaaactctgtcaactgttcagctggacttccttcttcctgaaaaattcgatctgacatatgtcggggaagacggaaaacctcatcgtccggtcgtcattcacagaggtgtcgtatcgacaatggaacgctttgtcgctttcttaattgaggagcataaaggcgcattgccgacatggcttgcccctgttcagttccaggtcatccctgtatcgccgtctgtgcatcttgactacgccaaaaaagttcaagagcgcctgcagcgtgaagggcttcgcgttgaagtcgatacccgcgacgagaaaatcggctataaaatccgtgaagcgcagatgcaaaaaatcccttacatgcttgtcgtcggcgaccaggaagttgaaaacgaagccgtcaacgtccgcaaatacggagagcaaaaatcagaaacggttgcaattgcagactttatcaaaaaagccgttgctgaagcaaagaaataaacaagaaaaaagcatgattcccgcccgggagtcatgcttttttgcttagcttgtccgctgcttgtccgcggaggatatcgaacagttcgcttaaatggctgatttcgtgatcaggtgcaacatcagtttcattctttttgcctttgcggttgacccagacggtttggatgcctgctctggaagccccgagaatgtcggtgttcaagttgtctccgaccatcacggcatcatcttttgtcatgccgaggagggtgaggcagtgttcaaatatgcttggatcaggctttccttttccgaattcaccggaaatcacgatttcattaaaataaggagcaagttccggtacgcctgccaacttttctttctgcaggctcggatcgccgtttgtcagcaaaagaagctctacttttcctttcagctcatctaaaacggcaaatgtttcttcataaacaaaagggctctttcggcgcactgccgcaaaatattcgccgagttcttccccgaaggcgggatcgtcgatgccaaacgccttcaatccgtttgtccatgcgtttcttctgtattcgggaacaattttgttcagtttttgaaacccttcgctgatcggctcgctgaagtttgaccacaggccttcaaatgggttgatgccgatcatgacggtgtatggatatgtttcataagacgtgtaaagctttcgcgctgcttcgcgcacggctgcttcaaattcttccgcatggattccgtatttttcttcagctttaaggcacgttttggaaaatgctgtactgacgcttttttcatcccagagcaatgtatcgtctaaatcaaaaaatacggctttcatcatcttctcctctgccattaatttatagaattctctcatttattttacaatagatcaaagggatgtgaaagaaatgatttaagaatgtgatgtaatgcagtatcaaagtatgaaagcttcttgaatatgataaaatgaaacgaaatctattgtttggaaaacgtttctaagatctatttgatgatggtgatgctggcccatgcgcgggaggaagaatcgttttatagttgaggagatggaaggaatggtattgtgaaaaaacgctgggtattttggtggatttgcaacatattgtggacggccgtttttgtaatcggagcagctgttgtttggctgagagatgttgatggcgctggtgttgctcaaacacctgaacttaaattaatagcatttatcgttttgttaattgcatttatatttccattcatcattcaagttgtgtggctgattgttaatttcaaagtgggaagcagcaaataagtaaacggcggcagacaattgctgccttttttattttgctcatgaagcggttttggccgttaaaaggttttaaagccatgccgtctcaaagagtgaataaagagaggtatgatagaataagagcagattccgattcagaaagaaagcaaggggaagtacatggtccaactcatgattatgatgctggagagagtggggatcatcgtcattctgggctttatgttggcccatatgaaggtgttccgtcagcacctacagcatccggaagggtataagggcaagggagttctcatctttattttttccttgttcagcatcatcagcaactatacaggcattgaaatccgggagcgcgagattttgaacaatgactggattttcgcaatcgacccgtcaagctcgattgccaatacgagaattctcggcgtcgaaatcggcggcttgatcggagggccgtttgtcggagcgggtgtcggactgctctcaggcattcaccgtttttcactgggagggacgacggctttgagctgcgcggtttcttcactgctggcaggtgtcattgcgggttatatcggcagctttttcaggaatcggcaccagatggtgacaccgcgggtagccgctcttgcgggcatttgtatggagggcctgcagatgcttatgattctcgtgcttgcaaaaccgcaggctgaggcacttgcgcttgttcagatgatcggcattccaatgacgattgtcaacgggacgggcagctttatttttctatcgatcattcagtctattatccgcaaagaggaacaggcgcgggccgttcagacccataaggtattttcgatagcggatcagacgcttccttttttccgccggggactgaatgaggattcctgcaaaagcgccgctctcattatacaccgcatgacagggacggatgccgtatcgattacggatagagagaacattctcgctcatgtcggagatggagcagatcatcatattccttcgaaaaatctgatcaccggtttatcgaaaaaagtcattcaaaccggaaaggtcatgaaagtgaagtcgcgcgatgaaatcgagtgtgcgcaccgttcctgtccgctgcaggcggcgatcgtactgccgctcttctccaaccgcgaaacaatcggcacgctgaagctgtacttcaagcacccgtccggtcttaaccgtgtgacggaagagctggccgaagggcttgccatgcttttttccactcagctagaactcggtgaggctgagctgcaaagcaagcttttgaaagatgccgaaatcaaggcgcttcaggcgcaggtcaatccgcactttttatttaatgccatccatacgatttctgctctgtgcaggacagatccggaaaaaacgcgaaaacttctcttgcagctgagcgtttattttcgttccaatctgcagggagccaggcagctgatgattccgctttcaaaagagctgaatcatctggaagcctatttatcattggagcaggcccgatttccgggcaagtatcatattgattttcatatcgaggacggccttgaaaatatggaaatccctccttttatcttgcagctgctcgttgaaaacgcgcttcgccatgcattcccgagaaaacaaaaggtatgcacggtaaaagtatgcgctgtgagagagcgggacggcgttttgatgaaggtgtcagacaacggcaggggaattaatccggagatgcttggacagctggggcaggcgcccgccccttcaaaggaaggaaatgggacggcgctttacaatgtgaaccagcggctcaccggtttgttcgggcaccaggctgctctgcagattgccagcgaacttgataaaggaacagagatatccttcaagattccttttcaaaccgaaagagaggggaacagagatgctcaaggtattaatcgtggatgatgaaatgtttgcgcgggacgagctgagatatttactagagcagactgaagaagtggatgcgattgacgaagctgaacatatcgaagaagcgtttgacaaaatggcggatcgcaaacccgatatcctctttttggacatcgatctgtcaggggagaacggttttgacattgcgcagcggctgaaaaaaatgtcggcgcctccggctgtcgtttttgcgaccgcttatgatgaatatgcgctgaaagcatttgaagtggatgcgattgattatttgacaaagccgtttgatgaggagcgaatcagacagacaatccacaaatataaaaggatgcgccccggcaaacaggaggagcggcagcttgcaggccaccacaggctggctctcagcattgacgaatcgatcgtcgtgctcgatcccgatgaaatcgtatacgccgggttagaaggcggacacgtcacagtgaagacttttgatcaggcatacacggttcacgatacattggttgtactcgaacaaaagctttcgcagacggcattgatcagggtgcacagaagttttctcgcaaatatggatcatattaaacaggtcaaaccctggttcaattcgacatacaacctcctgatgaaagacggctccacgatccctgtcagccgtacatacgcgaaagagctgaaaaaacggctgcatatggtgtgaaaaaatgatcagcggcggtgaagggcttaattcgtctttcaccgccgttttttagctaaaacatgcgctggagcccggggcgtcctgcttcaacggcgaacttggcataagttgaggctggagcgccgggacgtgtgatataaggaagaacctgaaagtcggcttcgagctgccggggcgtcaagcggcagcgaacatagccgcgctgtgcattgtacagtttgacatgcgggtttccgagccagatcggcgccaaagaatcggtctcgctgccgtcagcgtccgaagatatcgaagttgtgatcagctcggttccgattgtcgctgaccccgcatcatcgaagtccgcttttaagtcggcggcggcatgtctgtggatatcccctgtcagtacaacggggttttggatgccgtatgccttgtatgcggaaaaaagcctgtcgcggcaagcgggaaagccgtcccactggtctgtgctgtactcaactccaggacctgtgtcgcggtcgatttgagccagcacgacttgctggactaaaaagttccaaatcgtgtcagaccggctcaagccgtgaaaaagccagcgctcctggtcaaatccgagtatggagcgggatggctcaagccgttcagcctcatttgccggaaaattattgcggtactgccgggtgtccaaaacattgaattcagccaggtttccatagcggaaccgcctgtacatcagcatgtcaggcccctttggaatcgatgtgctgcggatcgggatattttcatagaaagcttgatacgccgctgcgcgctgccggagaaaatcgtccggagaagcattgtattgcgaatggatgccggcataattgttttcaacctcatggtcatccatcgtcacaacccagggagccagcgcatgaatggcctgaaggtccggatctgtcttaaaaagagaatatctgagtctgtattggctgagggtaacggtttttgcgttgtgggcagcggataaagtcacatcgcggaaaagatttttagcattaatggcatattcataaatatagtctccgaggaaaaaaacaacgtccggatggtcttcggccatatgccggtaagccgtaaaatacccgtggtaccaagcttggcacgaggcgagggcgaacgacatccccttgatgtcggcgtgcggggcaggcgcggtttttgtacggcctgtccggctgatttccctgcccgctttaaacctgtaccaataatagcttcccggctttaaaccgtgcacttcaacatgaacggagtgggcaagctcagcgagcgcagaggacgtcccgcgcttcaccactttgtgaaaatgttcatcttcagctacttcccactgaacagggacagctttgtcaggcattccccctaatccgtcttcggcaagcggatcggggccaagcctcgtccagatgacaaacccgtcgggatgcgggtctcctgaagccactccaagcttgaatggataatctgcaaatcggggcgcgcctgcggcgattgaagcgtcttcaggcatcaagccgcgccttgccaaagatgcaaattcgccagacggaacaaagcggcctcctcttgaatggtccatgggtcagggcctcctcatcaatttctcattaaccactatacgatcagcttagcttcattagcacattctggaatttaaataattgtgaagaatttgcaaagccggaagagtgatttgcatttcagcttcccatttctgcaattgaggggccgtatccggcaagttattttgaaaacgcttttttggggaggctctttttatataatgaacccaacacagccaaagaggtgaacgaaatgaagggtaaaaaagaatacggctttttaactcaggcatttatttttgctgttatgatgtttatttcaaacggaatcgccgcggttctgcccatcccgattcctccatctgtcatcggtttggtgctgttgtttgcattgctgtgtacgaaggtgctgaagcttgaacaagttgaatcgctcggcacggcgctcacttcgctgatcggctttttgttcgttccgtcgggaatatcagtgatgaattcgctcggcgtcatggagaaatacggattgccgatcgtcctcgtgattttcctggccaccgtcattctgcttgcagcgacaggattgttttcacagttcattctgtctgtcggcaaaaaggaccgtcaagacacacgagttgaaccagccaaaaaaacagcatcttgaatcaataggaggttctttacgctatgacaccttatttcggtatcgtcgtttcactggccgcatttggcaccggcacttttttatttaaaaaatcaaatggttttttcttattcacgcctctgtttgtcgcgatgattcttgggatcgcgtttttaaaaatcggcggtttttcatatgaggactacaagagcggcggagacatcattaagttctttttggagcccgccacaattgcgttcgccattcctttatataaacaggcggacaagttgaaaaagtattggctgcaaatccttggtgccattattgcaggctccgtctgctcggttgccgtcgtctatctgatcgcaaacgcgctccatcttgacggagccgtcatgaaaagcatgctgccccaggccgccacaacggcgattgctcttcctttatcaaaagggatcggcgggattcaagatattacggccttcgccgtcatctttaacgcagtgatcgtctatgcgctcggcgcgctttttttgaaaatcttcaaagtgcagcatccgatcgccaaagggttggcgctcggaacatcaggacatgccctcggcgtcgccgtcggaattgagatgggggaagtcgaagcggcaatggcgagtattgcagttgtcgtcgtcggcgtcgtgaccgtgtttgtcgttccgttatgtgttcaaatgatcggcggatagagcggctgaaagaaaaataaaaaaatagcattgctatttgaaatgtgtcctgatataatagcaaatgttgtgataaattttatatcttgacttgcaggatttgtttatgtaagatggataatgaattgaatatatatcaacaagcagaagcacccgcttctcacctgattgacacattcttgtagttggcaggttaaacgtacatttcttatttttctatgcaatgttcgcagtgtgggtgtttcgatgcccgcactttttgtttgcctgtggaatgcaaagaaacggtcaaaatgagttgtgaaatcaattcaaagattctatggaggtggctcattattagcaaagatcaattggttaatgagggtatccgtgcgcgtgaagttcgtttgatcggacaaaatggcgatcagcttgggatcaaatcccgccaggaagcactggaaattgcgggtcgcgcaaatcttgaccttgtgttggttgcagcgaatgcaaaaccgcctgtctgccggatcatggactatggaaagtacagattcgagcagcagaagaaggaaaaggaagcacgcaaaaatcaaaaaatcattaacttaaaagaagttcggctgagccctggtattgaagaacacgacttcaatacaaagcttcgcaacgccatcaagttcctgcaaaaaggggacaaagtgaaagcgtccatccgctttaaaggccgtgcgatcacgcataaagaaatcgggcagcgcgtgctggaccgtttttcagaagcctgcgcggaagtggcgactgttgaaacgaagccgaaaatggacggccgcagcatgttcctggtgctcgcgcctaaaactgaaaagtaattaaggaggaaacatccatgccaaaaatgaaaactcaccgcggatctgcgaaacgttttaaaaagacaggttccgggaaactgaaacgttctcatgcatatacaagtcacttgttcgcaaataaatctcaaaaacaaaagcgcaagcttcgcaaaagcgcagtcgtaagcgccggcgatttcaaacgcatcaagcagcagcttgccaacattaagtaatttcggaaaaggtataattaggagggaaatctaatgccaagagtaaaaggcggaactgttacacgcaaacgtcgtaaaaaggttctcaaattagcaaaaggttattttggttcaaaacatacattatataaagtagctaaccagcaggttatgaaatcaggaaactacgctttccgcgaccgtcgtcagaaaaagcgcgatttccgcaaactttggatcactcgtatcaatgctgcagcgcgcatgaacggtctttcttacagccgtttaatgcacggtcttaagctttccggtatcgaagtaaaccgcaaaatgcttgctgaccttgctgtaaacgatctgaacgcattcaatcagcttgcagacgctgctaaagcgcaattgaataaataattgaaaaaaggccgggctccggcctttttcttttgttcttcgagcaggatgtaaaacgattcggggaggccggccgcagcaggcgcccaaaccgaaaaacaaggggaaatgaacaattgactctcatatggatatacatgatcctcataaacggatacggttttttcttaatgaaagccgataagcaaaaagcggtcagaggcaaatggagggtgtctgagcgccgcatctggctcgttgcggctgcttttggctccgcaggcgtctggttcgggatgatgcggttcagacataagacaaaacacctttccttcaggctcggcattccttttttgctcggcgtgcaagctgttttgaccggcttttatatgatgaattaaaaaagcagacgaggctttattgctcttctgcttttttgtttttccacttttggatgttcgaatcccagtcgattttgcaatcgggatagtgctctttaatattttcttcaagttccgcgaagtcttcttccgtaaaagagctgagcttttcttcaggcgcttccgtccatacaaaaatcgtatggatgaacagcggatggtcttttgaaggaatgtgtttttctccttcgaaaagcacgcctttaaatgtcagcttgagatttttgcgtgtattcttttgttcgtccaaaacataaaagtgcttttttgcctgtgctgatttcagccttctgtccgggctccccaaaaattgaacggccctgtacacgacgtagaccaaaagcgccagcaaagccagtctcaatatgatgacaatcatgttaaaacagaacctcccttgaaagtaattttgagtatatcccaatatatacgaaccagttcccgcaaggtttcattttttaaccaaaaaagctgtaaacgatattggtcgtattgaaaagggatgtttctgtataatagtaaatgagggttaattaaggaggctgtatagagatggcaaagcttgatgaaacattgatgatgctaaaggaattaactgatgcaaaaggaattccggcgaatgaaaaagaacccagacaagtcatgaaatcgtacatagaaccgtttgccgacgaggttacgacagacagactgggaagcttaatcgcaaaaaagaccggacaggctgacggaccgaagattatgattgccggccatcttgatgaggtcggttttatggttacgcggatcgatgacaggggctatctccgctttcagacggtcggaggctggtggagccaggtcatgctggcgcagcgtgtgacggtcgtgacaaagaaaggcgacatcaccggtatcatcggttcaaagcctcctcatgtcctgtctcaggaggcgagaaaaaaatcggtcgatattaaagatatgtttatcgacatcggggcgtcgagcagggaggaagcgatggaatggggcgttcttccgggagaccaggtcgtcccttactttgaatttacggtgatgaataatgaaaaaatgctgcttgccaaagcatgggacaaccgtatcggctgcgcgatcgcaatcgacgtgctgaaaaacctgaaaggagccgatcatccgaatgtcgtctacggcgtcggaaccgtacaagaggaagtagggctgagaggcgcgaaaacagccgcgcatacgatcaagcctgatatcgctttcggtgtcgacgtgggaattgcgggtgatacgcctggtattaccgaaaaagagtcggcaagcaaaatgggaaaaggcccgcagatcatactttatgatgcatcaatggtgtcccataaagggcttcgcgactttgtaacgaatgtggcagatgaagccggcattccgtatcaatttgacgccctctcaggcggaggaacagattcaggatcaatccaccttaccgcgaacggagtgcctgccctgtcgatcacgatcgcgacgaggtatatccatacgcacgcggccatgcttcaccgggatgactatgaacatgcggtaaaattaattaccgaagtcattaaacgactggataaagagacggttcaaaacattacgtttgactgatgaaagagcaggctgacagcttatcttacaagctgtcagctttttttgttttttggaatgttaaagacagcgcttacatatataaacattgttcgaaaaattgacaaagaaagggaggcattgtttttttcattacaagaacaggagtgtgagctgaatgaaaaatgtgttgcggaaaatgtctttggcggccttgatattcggactgctgctgtctttttcgatgcctgaatcaggcaaagcggcgttttgggacacaaaaggggacaatttcatccatgacccttctatcattaaagagggaaatacatggtatacatttggaacagggctcggcacagggctgcgtgtcattaagtcaacagacgggagaaactggagtgctgccccgagtatttttccaactccattgtcatggtggaagatgtacgtaccaaatcatgaaccgcatcaatgggcaccggatatcagctactataacggccggtattggctgtactactcggtttcgtctttcggttcaaacacatcagcgatagggctcgcatcgacagaccggatttcatccggccaatggcgggatgacgggctggtcatcaggtcgacatccggcgatcagtttaatgccattgaccctgatctggtcattgacaaagacggaaacccctggctctcattcggttccttctggagcggcattaagctgacaaggcttgataaaaacacgatgaaaccgacgggaagcctgtattcgatcgcctcaaggccgaataacggaggagcggttgaagccccgaacattacctacaaagacggctactattacttatttgtctcgtttgacagctgctgcaaaggggtggacagcacatataaaatagcctatggccgttcaacgagcattacgggaccctattatgataaaagcggcaaaaatatgatgaacggcggagggacgatcctggactccggcaatgaccgctggaaagggccgggacatcaggatgttctgaacaactcgatccttgtcaggcatgcttacgacgcgctggacaatggtgtatcaaagctgctcatcaatgacttgtactgggattcccaagggtggccgacttattaacagcagatgacgggcggtttccgcccggtttttttgttctgaaatctgtcaaaaaaaataaaaaacataccggaaattaaattgacagtttttttcataatgatataatgaagttgttcgtacaaatatgtttttgatgttagttgtacgtacatataatcgcgatacagtttgagatcaaggtatgatttatgtttttttgtaagcgttttaatagtttgctattctacacagacaccataaagacgaggaggaggaagctatttgattcaggcaaagacgcatgtgttttggtttgtgacaggcagccagcatttatatggcgaagaggcggtacaagaggtagaagagcattccaaaatgatctgcaacggattaaatgacggagatttaaggtttcaagtcgagtacaaagcggtggccacttcgctggacggcgtcagaaaactgtttgaagaggcgaaccgggacgaagagtgcgcaggcatcatcacctggatgcatacgttttcaccggccaaaatgtggattcccggcctttccgagctgaataagccgctgctccattttcatacccagtttaaccgggacattccgtgggataaaatcgacatggatttcatgaatattaatcagtctgcccacggcgaccgcgaatacggttttatcggagcgagattgggcattcctcgaaaagtaatcgccggatattgggaagacagagaagtaaagcgctcgatcgacaaatggatgagcgcagcggtcgcatatattgaaagccgccatatcaaagtcgcccgatttggggacaacatgcggaatgtggcggtaacagaaggagataagattgaagcgcagattcagcttggctggtctgtcgacggatatggaatcggcgatctcgtcacggagatcaatgctgtatcagaacagagtctaagcgagctcatctccgaatatgaggagctttatgagtggccggaaggcgaagcggcaagggaatccgtcaaggagcaggcgcggattgagcttggattaaagcgctttctttcgagcggaggctatacggcctttacgacaacctttgaagacctccacggcatgaagcagcttccgggtttggctgttcagcggctgatggctgaaggctatggcttcggaggagaaggagattggaaaacggctgcgcttgtcaggatgatgaaaatgatggccggcggaaaagaaacgtcatttatggaggattacacgtaccattttgaaccgggcaatgaaatgatcctcggctcccacatgcttgaagtgtgcccttcgattgccgaacacaaaccgagaattgaagtccatccgctgtcaatgggtgcaaaggatgatccggcgcggctcgtgtttgacggaattgcaggtcctgcggtcaatgtctcccttattgatttgggcggacgtttcaggcttgtcatcaataaagtggaagctgtgaaggttccgcatgatatgccgaatcttccggtggcgcgcgtactttggaagcctcagccgtctctgagaacatcggctgaagcgtggattttggctggcggtgctcaccatacatgcctttcgtaccagctgacagccgagcagatgctcgattgggccgaaatgtcgggcattgaagcggtgttgatcaatcgtgatacaacgattttaaatcttcgcaatgaactcaaatggagtgaagctgcatatcggcttcgcaagttttaagggggtgaggacttatcccttacacaatcggagttgactttggaacattgtcagggcgtgcagttctcgtcgatgtccggacaggtgaggaaatcgcgacagctgtcaaagagtacacgcacggggtgatagaccgggagcttccggtctcaaagcgaaagcttccgagagactgggcgctccagcatccggccgattacattgaagtgctggaggaaacgattccgagccttttgaaacagtcaaaagcggatccgaaagaaatcatcggaatcggaatcgatttcacggcttgcacgattttgcccgttgacgagaacgggactcctctttgtatgagggaagagtatgcgtcggaaccgcacagctatgtgaagctttggaagcaccatgctgcacaggagcaggcgaatcgcttaaatcaaatcgcggaagaaagaaatgaaccttttcttcaaacatacggcgggaaaatttcttccgagtggctcgttccaaaagtgatgcaaatcgcggaagaagcgcctgacatttatgatgccgcagccgagatcatggaagcggccgactggatcgtctatatgctgtgcggaaccagaaagcgcaacaattgcacagcgggttataaagcgatttggaacaataagagcggctatccttccgacgatttcttcgcaagcctgcatccgaagctgaaaaatatcgttcgggaaaaactaacggaggatatttattctgtaggcgaaaaagcgggcggactgactgaagaaatggccgggaagacagggcttctggcaggtacggcggtcgctgtcgcaaatgttgatgctcatgtgtcggttccggcggtcggcatcacagagccgggcaagatgctgatgatcatgggaacgtctacctgtcatatgctgctcggcgaggatgtcaggatggtgccgggaatgtgcggcgtcgttgaagacgggattctgccgggctatgtcggctatgaagcgggccaatcgtgcgttggcgaccattttcattggctgattcaacactttgttccagaagcgtatttgaaagaagctgaagccgaagggatttccatttacgaactgctgtctcaaaaggccggcagtctccaaatcggtgaaagcggtttgcttgcattggattggtggaacggaaaccgttcaacactcgttgatgccgatctgacgggaatgctgctcggtatgacccttgccactaagcctgaagagatataccgtgcattggttgaagcgactgcctacgggacgaggatcattattgaaacgttcagacaaagcggcgtgccgatcgaggagctgtatgccgcaggaggaatcgccgaaaaaaatccgtttatcatgcaggtttacgcggatgtcaccaacatggaaatcaaaatttccggatctccgcaggcgccggctttaggttcagcgatattcggagcgctcgcggccggaagcatgaacggcggttacgaccatatcgaagaagcagtcgcacatatgggcaagatcaaggataaaacgtacaaaccaattcctgaaaacgtttccttatacgatcagctttatgcggaatataaggagctttacacgtacttcggaaagcaaaacaatgtgatgaaacgccttaaaaaattgaaaaacatccagtcccttagttctgacaccggtaaagcgatggcttagagggaggagaaaactgtgctggaatctttgaaagaacaagcattaaaagcgaatttgcagcttgaagaataccggcttgtcacctttacatggggaaatgtcagcggtattgaccgggagaataagctggtcgtcatcaagccgagcggtgtcaaatacagcgatttgaaagccgaagatttagtggttctgaatatggacggcgagattgtggaaggggatctgaagccatcttccgatacgccgacacacctctatctttaccggcagtttcaatcgatcggcgggatcgtccatacgcattccccgtgggcgacaagctgggctcagtcagggaaggacattccgtcgctcggaacgactcatgccgactactaccacggcgacattccgtgtacacgggaaatggatcccgatgaaatcaggagtcaatacgagctgaatacaggaaaagtgattgtagagacgttccggcatcttgaccccctggcggtgcccgccgttctcgtgaacaatcacgggccgttttgctggggaaaagacgccttaactgccgtacacaatgccgtcgtcctagaagaagtcgccaagatggcgtaccgctccctgatgctgaatccgtctcttaagcggattaagagcgctttgcaggataagcattattttcgaaagcacggggcagacgcctattacggccaatagaggagggaagctgccaatgaatgacttgatctcttatgtgaaaaaaactttgggcgcatgcgaatgcggaaccgtccaccacccgcttacagtcgaaaaaatcgcgatcggcgacaatgctgttgagcaagagctgcccgctttcgtgaaatcggcttcctataaaaaagccgctgtcatttatgatgaaacgaccggacggttagccggcaagcggattgcctctcttcttgaggaaacggctgaaacggttccggtgctgctggaagataatgaagcgggcgatgtgacggcggatgagcaaacattggtgagtgcattgatcggtgtaccgattgatgcggatgtactaattgcggccggagcgggcacgattcacgacatcgtcaggttttgcgcctatcagcgcggcattccgtttatttcagttcctacggctccgtcggttgacggttttacttcagccggcgcaccgctgattttaaaaggaaagaaacagacggttcaaacgacagcgccgatcgcgctttttgccgatttggagctcttgtgtcaagcgccgcagaacatggtagccgcaggttttggcgatatgctcggcaaggtgacgtcgcttgcggattgggagatttcccgcttgcttgccggcgagccgtattgtccggccgccagccggctcacgagggaagcgcttgatcaatgtcttgaccgaaaagacgacatcgccgccaagatgcgggatgggattgagaaattgatggaatcgctgatcctttctggcctagtcatgctggttctcgaccattcaaggccggcttccggcggcgagcaccatctttcccactaccttgaaatgaaagcgctggagaacaataagcggcaagtgctccacggtgctaaagtcggctgcagcgcgattatgctgactgacatttaccgatctcttatcggtgcaagcctgggtgatcaacacgctgagcaagcgattcgctccgtttatgaaaagctccctgacggtaagaaaatggcagagtggatgaggcgtatcggcgggcctgtatcattcaaagaactcgatgttgaagaagagctggtgagagaagcgctcgcatacgcccatcagctcagagaccggtatacgggactgaaaatcatcaatcaatacggccttttgccggggcttttaggcaaaggaccaggcgtgaaaggggttaaaatgtgaaaaggttcctttcatctatctttatggtcacggtcgctgtatgtttgcttttatcggggtgcaaggcgagtcctgcctccgatcaagccgatcaagcggacggcaccgaactgacattttggacattcaacggccttcatgaacagttttatgctgagatggtgaaagaatggaacaaaaagtatcccgagcgaaaaatcaaattaaatacagtggtgtatccgtatggacagatgcatgacaatttatctatctcgcttttagccgggaaaggggttccagatattgccgatgttgagctggggcgctattcgaactttttgaagggctctgacattcctcttaccgatttaacgccgcttgtggaggacgaacgcgacaagtttgttgaagcgaggctgacgctctacagcaagaacggcaagctttacggacttgacacacatgtcggaacaaccgtgatgtattacaacatggaaatgatgaataaagcaggcgttgatccggacgacatcaaaacatgggaagattacagggaagcgggcaaaaaggtcgtcaaagctctcggaaagccgatgacgacgattgaaacgaccgacccgaattcatttctgccgctggtttcccagcagggatccggttactttgatgagcaggggcggttgacattaaacaatgagacaaacgtgaaaacgctcgaatttttaaagactttaattgagaaagacaaaattgccgtcacaacgcccggaggcaatcatcacagtgaagagtattacggatttatgaaccaaggcggcgcggcgtctgtcttaatgccgatctggtatatgggccgttttttggattatatgcctgacttgaaagggaaaatcgcgatcagaccgctgccggcatgggaagaagggggagaccgctcagcgggaatgggcggaacggccaccgtgattccaaaacaggcgaaacaggtcgatctggccaaggatttcttgaaatttgccaaagcgtcaaaagaaggcaacatcaagctgtggaccgtgctcgggttcgatccgctcagatgggatgtgtgggactcggacgaattgaaaaaaccaaatcaatatacagaatactttcaaaacggacaacacatcttttccgtgcttcttgacataaaggatgagatcaatccgctttaccttactgaggattatgcgaagacttccgatctcgtcaacagaaacatactgtacgaagcgctcaaaacgaagagcaaaacaccgaaagaagcattggacaaagcagcagctgaagtgaaagggcaatagtctttcattactgtaaagcgaggcgataacttgaagactgttaaaacagatacagtgcattcgtttccgccggtgagcagaaaaagaaagatcagacgtttattatattcagcaaaagccgcaccctacatttttacagcaccttttgtactctccttttgcatattttttctttatccgcttatcagcgtcgtcatcatgagttttcaaagcattctccccggggaagtccgcttcatcgggacggagaactataaagcattaaacaatcctacattttataccgcactattcaacaccgtaaaatacaccttttggacattgctgattttaatacctgttcctcttattctggcagtctttttagattctaaactcgtaaaggttaaaaacgtgttcaaatcggctttattcatcccggctctgacttcaaccattgtggcggggattattttcaggctgatttttggagaaatggatacatccctggcgaattcgatattggctaagctcggaggttcgccgtacaactggctgaacaatgaacataccggcatgtttttaatggtgatgctcgcatcttggagatggatggggatcaatgtcctgtactttttggcgggcttgcagaacgttccgaaagaattgtatgaagctgccgaaatcgacggggcaggcacgttcaagaagttttaccatattacgcttccgtttttaaagcccgtcagcgtctacgtgctgacgatcagcatcatcggcggcttccggatgtttgaagaaagctacgtgctgtggcagaacaactctccgggcaacatcggcctgacgatggtcggatacatttatcagcaggggcttgcctacaacaacatgggctacggatcggcgctcggcatcgtgctcttgatcatcattttcatctgcagcctcatttcattaaagctgtctggatcttttaaaaaggagggctattaatgcgtcctgccggaggcctcaacattgcgaaagcagctctgtttctgctgtttgcgatattaagctttttgtttgtgtttccgctcttctgccttgtactcggctcgctcaagccatcttcggaattgctgcgcttcggcctgaatttaaagctgagccctgaaatcctgagccttgacaattacacttacttgtttaacggaggcagcatttattttcaatggttttcgaacagcttgattctcgtggtgatatccaccgtgctgacgctcttgttttcttcaatggtcggatacgggcttgccgtctacgactttaaaggaaaaaatctcttgttcgtagccgtgctcctgatcatgatggtgccgatcgaaattctcatgctgcctttatttaaaatgacggtttctcttcatattgtcgacacatacgccggtgtgatcctgccgtttatcgtctcgcctgtagccgtgtttttcttcagacagtatgcgctcggcctgccgagagatttgcttgattccgcgagaatggacggctgcacagagttcggcatttacttcaggatcatggcgcccttgatgaagccggcatttggagcgatgatcattcttcaatccttaaacagctggaacaacttcttatggccgctgatcgttttgcgatcgaaagaaatgtttacgctcccaatcggactgtccgctttgctcagtccgtacgggaacaattatgacatgttgatttcgggttctgtgctggcgattctgcccgtgattctcatcttcctgttcttccagaagtactttatatcaggtttgacggcgggcggaatcaaaggctgatccactatatatcatcttgaaaggaatgatttaacatgactgtacacaaagcgaagatgacgattgacaaggaatataaggtggcagagattgataagcgaatttacggctcctttatcgagcatctcggcagagccgtttatgaaggcatttatgagcctgatcatcctgaagctgacgaatcaggctttcggaaagatgtcattaaactagtcagagaactaaaggtgccgtttatcaggtatcccggcggaaactttgtatctggatataactgggaggatggagtcggacctgtcgaacagcggccgacaagacttgatttggcgtgggcgacaaccgagccgaacttaatcggtacgaacgaatttatggattgggcaaagcttgtcggggcagaggtgaatatggccgtcaacctcggaacgagaggaattgatgccgcacgcaacctagtagaatattgcaaccatccgtcaggatcgtactacagcgacttgagaaaatcccacggatataaggaaccgcataaaattaaaacatggtgcctcggcaatgaaatggacggtccatggcaaatcggccataaaacagcggccgaatacggaagacttgccgctgaagccgcgaaggtgatgaaatggacggacccgtcgatcgagcttgtcgcctgcggaagttcgggaagcggaatgccgacattcatcgactgggaaacgaccgtgcttgaccatacgtacgaacacgtcgagtacatctcgcttcactcgtattacggcaaccgcgacaatgatcttccaaactatttggcgagatcgctagacatggatcactttatcaaaacggtcatctcagtctgcgactatatgaaagcgaaaaagaaaagcaagaaaacgattcacctttcatatgatgagtggaatgtctggtatcactcgaatgaaaaagacaaagaagctgaacgctgggcgaaagcgccgcaccttcttgaagacatctacaactttgaggatgcgcttctcgtcggctgtatgctgattacgatgctcaagcatgccgaccgcgtgaaaatcgcctgtctggctcagcttgtcaatgtcatcgcgccgattatgacagacaaagggggagaagcatggcgtcagaccattttctatccgtttatgcacgcttccgtctacggcagaggaacggtactgcagacggcggtatcgtctccaaagtatgatgcgaaagactttacggatgtgccgtacttggagtccgtgtctgttttcaatgaagaagccgaggaattaaccgtttttgccgtcaaccgcgcaacagacgccggccttgaaatggaagccgatatgagaagctttgaagggtacagtgtctctgagcacatcgttctggaacacgaagatcataaagcgacgaatgaaaaagaccgcaacaacgtcgttccgcacagcggcggagacgccaaagtatgtgacggcaggctgacggctcaccttccgaagctttcctggaatgtgatcagaatgaagaaacaatgattgaaaaaccggcccgaagaggccggttttttcagatgaaaaaaaggcttcagcaaatatgccgaagaataagttaaaacgggaagaggatttatgaagacgtttttttcggctgcgtactgttttttgatgtacgcatttttagcatacctttggcttctgtttatcacggcgatccttgaccggccccggtttcttaatcactcacttttagaggcgggcgtcatcttgatcggcaccattttgtttttttcgctgtcccaccatttctcagcttcgcttgtcaaaacaaatgtcaatcgaatcgcggggaccgccgctttttgtctagtgatggccgttcatttttttatcgttccgttatgctgacagaaaaaaggcggatatccgatgatacccgccaattacgccttaaaaaaggcagcagatgaagcttgtgtctattttattcttattattcctattagtcaactatgttttaattatcgggactgaaaaaacgcacaaaagatgattgcgcttacaaaaaatatgagctatgttaaaaaagagacaaagggggggaggaattggatgaatgcaataacaattgtgatcgcttccatctgtattttggcgatcgcctatcgtttgtacggaacatttatgatggtgaaagtgttgaaggttgatgacgacaagccgactcctgcccatcttcagaaagacggcaaagattatgtgccgacgaacaaatgggtgtctttcggccaccactttgcggccatcgcagccgcggggccgcttgtcgggccgatcttggcggcgcagttcggctacttgccggggctgttgtggctcctgatcggagcggtcatcgggggcgccgtgcatgatattgttgttttatttgcgtcgatgcggaggaagggaaagtcgctttcagaagtggcgaaagaagagctcgggcctgttgcgggattttgcacggggcttgcgatgctgtttattattacaatcacgatggcggggctgtcgatggttgtgcttcatgcgcttgaacgcaatccgtgggggacgttcgccgttgcgattacaattccgatcgcgatgggggtcggcttattttataaaaagacaggcaacttaaaattagcgtctaccggcggatttattttgctgatggccggtgtcttcatcgggccctccattgcagagacgccgcttggagacgccttgacgctcgatacgaaaacgcttgctgtcgcacttcctgtctatgcattttttgcagcggcgctgcctgtatggctgctgctcgcaccgcgcgattatttgagcagctttatgaaaatcggggtgtttatcgctttgattgccggggttttcgttgtcaatccggcgattccgtttccggcgtttaccgagttcacgggcggagggggacctgtttcgcctggtccggtctggccgttcatttcaattacgatcgcctgcggtgcgatttccggtttccatgcgtttgtcggttcaggcacgacgccgaagatgcttgacaagtggagcgacatgaaattcgtcggcttcggagcgatgctcgttgagtgtcttgtcggcatcatggctttaatcgcggcaacggcgttgcagccgggcgattattttgccatcaacagttcgccagaagtctttcggacgcttggcatgaatgtcgtccatctgcctgaactcagccgcgaaatcggtctcgatcttgaaggaagaacaggcggagctgttacccttgccgtcggcatggcttatattttcacggatattccgtttttcagccatttggcctcttactttttccaatttgtcatcatgtttgaagctgtctttattttaacggcgatcgatgccggtacaagggtggcgcgttatttgattcaagactttttcggggaagtgtacaaaccgctgaaaaaaacggactggcttccgggttcggtcgcagcgagcgcccttgcctgtttcatgtggggatatttgctgtactcaggcgatatcagctcgatttgggcgctgtttggcgtatccaaccagctgatggcatccgtcggtttaattatcggagcgacggtcattttaaaaattgcggacaaacggcgttatatgctgacatgtctcattccgctcgcttatttgtatgtgacggtcaactatgcgggatactggatgatcaaaaacgtttattttaatgcggaagctgccggtttcagcgttttaaacggcattttatcgatcattatgcttgtgttgggacttgtgatcatggctgcagccattaaaaaatggacggagatttggcgcgatccggcattgcggatggagccttctatacctggatgatcaaataaaccggggccgtttggccgccggtttatttcgcttttaatccttgttccaatgtctcgagcatttcggttttgtctgattcagttgcgtgctgccagatgacctcgaacaacacacccaatcccggaagcattttttcttcaccgctttggatcgcatcgacgatcgtatgttcaagctcttcttgcgagttccctgatacattggcaataacggcatggcgcaaattcaaatccatcatttttcactccatttcatcatctgtttttctatattctgcctcgctttcgggtttattatgtatcattgatgagatataatgtgactattgcgagacaaaaggagtcaaaacgatttgaaacgaattgaatcagccaaaaatcaaaaagtgaaggactggaaaaaacttcatgcaaaaaaagagcggacaaaaacgaatactttcttaatagaaggcgagcatctcgttgaggaagcgctgaagacaccgggtgttgtgaaagaaatcatggtcgcagacgaagcggacttcccggctatgattgatgagtctgttgcccgctatgttttgagcgccgatgctttttcagcgattgccgaaacggagacacctcaggcggtcgccgctgtatgccgaatgcccgaaagcggaccttttcaatacgaaaagctgctgctagctgatgctgtgcaggacccgggcaatttagggacgatcatccggacggcagacgcggcggggatcgatgccgttgttatcggacaagggactgtcgacccttacaatgccaaaacgctcaggtcggctcaaggctcgcattttcacatcccgattttaaaacgcgagctttcagagctgattgaagagctgaagggaaaaagcgtcccggtttacggcacagcgctgcagggtgccgtgccatttagagaagcggagccgtcgcagtcgtttgcgctattgatcggaaacgaaggatctggggtcgatccggccctcctcgcacagaccgaccaaaatctgtacgttccgatctacggaaaagcggagtcgctcaatgtggcggccgcagccgcggtccttctttatcatctccgcggataaccggttgcacaggatcatgtaattcactataatgaatttaatatgtttaaaaacagtgatagaggctccgttttttcacatgccgccattcagggagaaaatgcctgagactgcaagcatttttatggcaggccggaaaaacgcttcacctcttgagttgtcaccgggaccacgtccctcgagggatgtgtaaaggtgaaccggatttattccgttatgccaatgaagtaagcagcaaagcttttttgctttgttttaaaaaagggtggtaccacggccacgattcgtccctttcattataaaaggggctttttttattgcctaaaaaacaggttgctacataaaaggaggagtttttaagatgcaggaagagctgaaacggcttgaaaaagaagcggttgaaaaagtggaagccgctggttcattaaaagaagtcaacgatgtccgcgttgcgtatctgggaaaaaagggaccgatcacagaagtgcttcggggaatgggaaagctgtccgctgaagaaaggccgaaaatgggggccttggcgaacgaagtaagagagaaaatcgccgcggcgatcgccgaaaaaaatgcccgccttgaggaagaagaggtgaaaaggaagctgaaagagcagacgattgacgtgacgcttccgggaagccctgtgaaaacaggagcgcggcatccgctgacgatcgttattgaagaaatcgaagacttgtttatcagcatgggatattcggtggaagaggggcctgaagtggaaaccgactattataacttcgaagcgctcaaccttccgaaagagcacccggcccgggatatgcaagacagcttttatattacggaagatacgctgatgagaacacagacatctcctgttcagacgcgcacgatggaaaaacataaaggcaaaggccctgtcaaaatcatctgccccggcaaagtgtaccgccgcgacaacgatgatgcgacacattcccatcagtttatgcagattgaagggctctgcgttgaccgtgatatcagcatgagcgacttaaaaggaaccctggaaacggtcgcgaaaaagatgttcggcgaagagcgcgaaatcagactgcgtccaagcttcttcccgtttacagagccgtctgtcgaagtcgatgtttcctgctttaaatgcggaggcaaaggctgctccgtttgtaaacaaacgggctggatcgaaattctcggcgccggaatggtgcatccgaacgtgctcgaaatggccggattctattccaaacaatatcagggatttgcttttgggatgggcgttgaacggatcgcaatgctgaagtacggcattgacgacattcgtcatttctatacgaacgatgtcagatttttatctcaatttaaacaagcttaaagaggaggacgcgtgatgtttgtttcatataaatggctgcaagaatacgtgaatttagacgagatgactcccgagattctcgctgaaaagattacaagaagcggaattgaagtggaaggcatcgaatataagggagaaggaattaaaggtgttgtcattggacatgtgctggagcgcgaacagcatccgaacgccgacaaattaaacaaatgcctcgtcgatatcggcgaagaagagcctgtccagatcatctgcggggctccgaatgtagacaaagggcaaaaagtagccgtcgccacggttggcgcggtattgcccggcaattttaaaatcaaaaaggctaagctccgcggggaagcgtctaacggcatgatctgctctttgcaggagcttggcattcaaggcaagcttgtgccgaaagaatatgcggaaggcatcttcgttttcccgggcgatgctgaaaccggtgcggacgcccttcaaagcctggcgctcgacgatgcagttctcgaactgggactgacgccaaaccgcgccgacgccatgaacatgctcggtgttgcctatgaagtggctgcgattctcggccgcgaagtcaagctccctgagacggcttatcaggcaggcgccgaaaaagcggcggactatatttccgtcaaaattgaagatacagaagccaatcctttatacgcggcgaaaatcattaaagacgtcaaaatcggcccgtcgccgctttggatgcagacgaagctgatcaacgccggcatcagaccgcacaacaatgtcgtcgacattacgaactttgtgctgctcgaatacggccagccgctccacgcgtttgattatgaccgcttcggctcaaaagaggtcgtcatccgcaaagcgtacgagaacgaaacgataacgacgctcgacgaacaagaaagaacgctgacccctgagcaccttgtcatcacaaacggctcttctccgcaggctgtcgcaggcgtaatgggcggagcggaatcagaagtccgcgaagatacggcgacagtgctgctggaagcggcgtatttcaacggccagaccgttcgcaaagcatcaaaggacctaggtcttcgcagcgaatcaagcgtccgctttgaaaaaggcatcgatcctgcacgggtgcgcctcgctgcagaacgcgcggcagatttgatcagccggtatgccggaggaaccatcttggaaggtacggtcgaagaaaaccatcttgacatcaaagagaatgtcatccgcctttccgttgataaagtgacgaaggttctcggcatgtccatcagcaaagaagaaatggtcaacatttttgaaaggctcggctttgcagttgaagacgctgaacgtgaactggtcgtgacggttccgtcaagaagaggcgatattgcgattgaagaagatttgatcgaagaggtcgcaagactgtacggatatgacaacattccgtcgacactgccggaagtaacaggctttgcgggcggactgacaccttatcaggacaagcgcagaaaagtaagacgcttcctggaaggagcagggctttcccaggcgatcacatactcattaacaaacgataaaaaagcgacggcttacgcattggaaaaatcgtttaaaacgatcctttcactgccgatgagcgaggaaagaagcgtgctgaggcacagcctgctccctaatctgctcgattcggttgcatacaacttggcaaggcaggccgattcagctgctttttatgaaatcggttctgttttcttgaaagccgaagaacatacgaaaccggtcgaaaaagaacacgtcgccggagccgtgacaggcctgtggcacaaaaacctctggcagggcgagaaaaagccggttgatttcttcgtcgtaaaaggcatcgtcgaaggtctgttggaaaagctcggaatcaccgaaggcatcgaattcgctcaatctgaaagaaaagagcttcatcctgggcggacagccaatattttgcacaacggctcattagtcggcttcatcggccagctgcatccgtcagttgaaaaagagctggacctgagcgacacgtatgtgtttgaactggacctgcacgagctcctccgattggatgtaccggagatcacgtatacaccaattccgaagtatccttctgttacaagggacatcgcgcttgttgtagacaaacaaacaacggccggccagcttgaggacgtcatcaaaacagcaggcggcaaatggctgaaagaagtccatgtctttgacgtctatgaaggcgagcacatggaagaaggcaagaagtccgtcgccttcagcctgcaatatttgaatcctgaacagacattgacagaagaagaagtgacaaaagtccacgaccaagtgctgaaagcgctggaagataaatatcaggctgtattgagaggataaagaaaaaccggtccccgatcatttgggaaccggtttttttgcattggaaaaattgtcggcctattgtaagttttaattattttaggatggcaagaatatttatgtaaaatattttgaattaagttgtatcgaattctcatatgttatttaatgagtctatacgaaggtaatctatgcaagaatatcggagaaaatagatatggcaatagaaaataaaaacaatatgaaaaaagaaaaagagtatttaatttttagtgagttttctttcttttctagacataaatagcaccaaaaaaataacgaaattaaagaaaaaatgtttaaatttcttaaaaaaggaatagaaaaaagactttcagcatcttttaagccaaatagataaaagacaataactaagacactgcctacaagattgaaatagtaggaaagaacaccttttgaaaaaatgtttttaaaggaatcctttgctccaaaaatcataatagcgagccaaatgattaaagtgaaaaataaaagctcaagaaggggttttatcgcttcgccaattactgctattgtaatgccaatccatttactgatagtaataagatttccatattcatcttcgtttaattcatgtaagctagcatcgatctcattcatttttaaaatggaaacacataaggctgcagctccagataatagacaaatacatattaagttgaatttagtcttcttcatattgaactccttattttagtaatattacgtagtattcgacaatagatgctaagattagaaggcctactgcacttatcattattattgtgtactcttttactttcggcttaatcattaggtttatttcagacttttttagaaatcttaaaaaacgggaagaaatatcaagagatattacataaaaagcaagaagggcaaggatttcaaaggggccgtgaaataagagatattgtagtgatttccaaaaacctaaagacttctcatatgaaaagaaaattgcccctgagaaataaccgtttaaaaacactactacactagataggaaaccaacactgattaatccaagaaagaaaatagttagtcctacaattaagttatttgtaaaaatctctaaagcgttggatattttaaagctatcatagtaagtctcgtgtatttcttgaaatacaaaaaagctaagagaaaaaccgaaaccaaaaataataatgaacaaaatagagtatttagcataggtattcaaggaattttttttcaaggctggcttcattaaatgtctccccggctaattttttttcagtgtggataatatttccgttattaataaataatatctcatcacaaagatctgctgcaaactgtaagatatgcgtggataaaataataattctattttgatttctaatattaattaaaatctttttcatatccgccatgttttttggatcaagtcctgtaaaaggctcatcaagcaagataacatcaggttgatgcaaagtggaaagaataaaagacattctttgacgcattcctcttgatagcgaagatgccatttggtctttttgttcttttagactgaacatgtctaaggtttcaatgatttgttcttgggataatggtttttcaattaataaagattggtacttgattaattcataacacgttaaattctcaaataattttggatcgtcttctaggtatccgattttctctaaataattggtaagatgtccatcaacgactacctcaccgctatccggaggaatgaggcctgcaataatttctaatagggtcgtttttcctgctccgtttttaccgagcaatccaataatctgatttcgcccgcaagtgaattctaaattcttcatgctaaaattggattgaggatattcttttgatatattttgcagtttaagcatataatcactcactcgaataaagattttattgatatgtaatttttgttgattgttgatttccatatttgcttgtttatggagtgcagtagcgttatgatacataacaaagtgataaaaataacaacatacaaaactttgttgtaagttgaaacaatggctaaccctattagtaatccaaatactaaattaagaaagattttgcttaaagtactgggaacttgataaatgtaatcccatttaaaatatggaaacaatatagttgaagtgagacagcttaaccccaaagtaacagctatcatcaataagataatggataatgcaataaaatgatccggttttatataaaaatttgaaatcgcagcatagattaaaacaaataacacatgtgctaagacagagattttggtttttgcttttattttgtttttaataaagtttggcttgtgctgattcaaaggtataataagaccatcaatatcaaaagaaaccaatgattgaatcatgatagagataaagactaacgggaacagcacgctgaacataaagctgaattcgttggaaattccagtgtctgcaaatcgatcagtgttaaaaccatacaaaatgattgttagtaaacctgctgataaacttaaaataaataataaaaccgaccaccttacaggcgggttcctatatagaaggatcagctcgtaatatagaaggcttctgctctctctagacttcttcaaatttgtatcagtcttgctatttaaatgatcattaaaaatggaaaggtttcttaaacttttataccacactataattaacaggattgttaaagataccattattggtatagatattgaaaaaattcgcatattattgatgtttagaaataacaaattatatttgagtataaaaaagatccaaagaattaaaattccatttgtgaaaaagccaataatgcttgagacatttatgaatttaggcaatactaatagccttataaaatgaagtctaaacaaatatcctagtatagcggacaataaaccaatcacagcaatcgcgaagacttcttccaaagactgatgaatgagataatatacaatcgatgaaccaacataaaaagatattaaagataaaaatgaactataaaatttactaatatcttttcctaatataaattgatccaatttgattcccagaatggccatttgttttttgtcggaggaaaacataactctgaaaatacttttatcaatatttacagtaaggataaacagaaaaaaagaaagatgaatgatgactagatttttaatgatgtacccagcaaagctgccaattattaaagggaaaacaacgaatgacaatatcaatacgaataatgcaagccatttgcttttagtattaaattttcgaatgtcgttggttaaaagaatttttgaataaattaagtatttattattcattgaaaaccatcctgacttaaatgtggaggaaagggcattttaaataataccctttcctaaattaaaacttattagtaagcgatagcatatctaattccgtatttttttgcataggaaaaaactagggatgcaatcgctccgagtccaaaagtccctagaaccgctgcaattgctccaacagtgccagcagcatttaagatggcactaattgaagtaagagcccatcccggaatctgaggataggttgctgctaggtctgcaatcggtaaaactggtgctgttgttgcgtataacattgtgaaaaatgtaagtgtaaaaagtagacctaaggctaaagaagcgttgatgcgttgttttttagaaattgtcatattttcaccccctttgtctcttgtagggctattattacacttatggttattttagtaaatagaacggattatctattctatttttattgatatataaatcaaaagtttctttttagaaaggaattacaatctcattttcttatttttattggttgaatatatcgaatatactgtgtttagatagaatgttagtagtttaatatagtcttgttagggggggcgatatctcctctgtatagaacgaaattcatgactcaattctcaagaattctggaaaaaggcatttatagcccgcatattaaaatcctagccaaggaagaagtgacaaaagttcacgaccaagtgctgaaggcacttgaggatacgtatcaggctgtattgagaggataaagaaaaaccggtccccgatcattcgggaaccggttttttatcttcaacatggtcataagctattgacgcttcagcatccgttcgattttctcttcatcggagtctaaagctccgtacagtacaccgggcatgctgtattgattccgcttccctgctgcagtataacgtaaaacaggggtgaccgtataaaaatcatattcgcctgtcatatgaaaagacgggacgacgatgtgtttgctttgtttcgcttgaatggcggtccccttgtcaaatgtatacgccatgacgccgtttagatcggtgatcttttcaagggaaatatcttttgcgagattgtttttcagccgaacgtccaaggacggttttggatatcctgcagtatattgaccggcaggcgacagatcgccgcttcgaacattgtgatggttttgaagggtgatctttccgatttgaaatgcttctctatcacgtccgttaaaagatatcagcagctgatccgctttttccggtttatcgcttgagacccggacatctacgatgatgttgacgagcgtatagcctttatggcgaatccctgtttcaaccttgtaatcgctgatttgtatatgattgttatcaaaagcgagcgacgtaaccgtctcaccgcttagaggaacgccggcgtttgctttttgcaggccgaaaatgttaaacgacatcgtctcgttttccatcatatggctgatgtagtttcgggcaaagaaaagcccggtttctttattttcgctggtctctgtaaagttcgccttgttgaagaaaataaagagagaaaatgccagagctgtgcatatggtgagcgtgatgatccattttatttttgacatggtgattcctttctgagtctgtcgatttgtatgagaaggaatgcggagatattcgcaataatcatccatagaggtccaatgatttcgccatataaagaagagaaggttcaaacatttcacagccggtcaaaattcagcagggtgtctgaatttcagtttgcttgaaaaaaggtgtagcaaatatattaaagattagctcgattaagctaatcttttttatttagaagaaaatatcccaatttagaaagtaagtacaaagtgaacacaatcattaaagttcttgaaatcacgagattccatgaatggctaagtcatatcctgaagatcaaagcctttgtatttaacataaaatacattgatattatgagagctgaaataattaaaagaatgccaaatgaacctgatttcttcatccaaatccccgccttatatcttagaagtatccagaaacaaaggagtacacattcaaaagccatctggtgtgcagtaagctgaaaattgagataattgaatatgggccatattaaaagacaatatcatgaagcaattcagcctagcgcttgatatcgctttgcctctgttggaacaattaaagcccctgtatatggggcttcaattctaagtttgttcaatatactacaattaatttgaattttcaatccttatttttcatttattgttaatgttttagtgaaatatgcgggtctagttgcaacggacccgcttatccagcctagtccgcaccgcttaccgtttcgacgcaatccgcttcgccttctgcgtattggcaaaatgcagctttgtgaatacccgcaatgcgtcttcgccgtgtttcttgatcagcttggcgccggcttcatcgacgagcgggcccgctcctttcggaagcgtaatgccggcttgttttgacagcttatccatttccattaaaaatgaatagcgtgcaatgatcgaggctgctgcaactgaaagatggatgccttccgcttttgtgctgaaatatgtacgttctttgacggcggttttgcctgccagatgcttgaagtatacggccggttcggcgaactggtcgattaaaatcgcttcaggccgggttccgtccaattttttgagaaggttgccgatcgcctggttgtggagaagagctttcatttttccttggctcatccctttttcctgcatttcattatacttttcgtttcttaaaacgagcaggctgtaagggactgtcttgattaagtcgcgcgcgatctgaacgatttgcggatcttttaagtttttcgagtctttaacaccgagttcttttaacagcggaagcttcgccttgtcagcgtatacgcacgcgacggtgatcgggccgaaataatcgcctgtcccgacttcatcggagccgatcacagacatggaaccgatgccttcaggcggctgatagacggacgggatgctttttttcgatgcgggctttttgggagccggtgtttcagcatccgccgtccagcgctccgcttccttttccgcgttttttccttggaacagcaccttccccgaccggtatgctgtaatggtgcacccttggggtttggcttggaaaactgcgccctgtacggaaagtgaagtaatgtcaggcccgtagtggctttgcatccgttcaataacagacgggggaacttttaaaacagaatgtgacacgttctaatctcctttattagctttaaatacgctaaatcattgttttcataagtgtatcataacagcggagggctcgtctttccattcaatctgtaaacatgttatgatatagactaggattctcgcataattggaatggaggagaaacgttgtctgatggtcaaaaaacgaaaacaacagttgacatctacggtcagcaattcacaattgtcggcgatgagagcaagagccatatgaggcacgttgcctcgattgtggatgataaaatgagagaaatcaacgaaaaaaatccgtatcttgatataaataaactggccgttttgacggctgtaaatgtggttcacgattatttgaagcttaaggaagagcttgagagattaaaaggacaaataaaagaaaaggattgaacatcacgatgttagatatcatcattatcattttgcttttgtccggtttgtttattggactcaaaagagggtttatccgccagtttatccgtttggttacgtttatcgcagcgatcgctgtggccgcaacctattacggcgaccttgcgcctaagctcggctggattccgtctcccgactttacgggcggccaggctgcgctggcgtttgtaaacggaagccttgaaggcgcttattacaatatgattgcgtttttgattctctttatcctgacgattatccttttgagagttgccgcatcgtttttggatgccgtcgcaagcataccggttctcaaacagatcaaccaaatactcggagccgtgctcggttttgcggaaatctatctgttcgtgtttgtcgttctgttcatcggaacgcttctgccgattgatgtcctgcaaagcatgatggccggttcagtcatggctgatttgatcattcataaaacaccgtttttatcaaacatgttaaacaatctgctgcatcagtacggatctttgtaaaaacttctctgtttgtagggaagttttttttcggggctcttgagaaccccggaagctgtcggatatgcctgtttgttgtaggatcagccaaaaatttgtatgattgaagcaggatgaacgaggggaaacaagaggtgaacaacatgcataaaaaagatatcatcaaattgcttgaaacgattgcgatatatatggaactaaaaggggacaacccgtttaaaatctccgctttcagaaaggctgcggcagctcttgaacaagacgaccggagcctctcggaaatcgatgatatgacgtccctgtccgggatcggcaaaggcacatacgctgtcatcaaggaatatatggacacgggagcatccggaacgctggaacgattaaaggaagaggttccggaaggacttgtcccgcttttgaagcttccgggtctcggcggcaaaaaaatcgccaagctgtatcaggagctcggcgtctgtgatgcggcatctttaaaagaggcctgcgaacagcaaaaggttcaggggcttgccggattcggcaaaaagacggaggaaaaaatcctgcaggctttgggtgaagcgggaaaacgccctgaacggtacccgatcgcggtcgctttggccgtcgctgacatcatcgaagagcagcttgaagggctcccgggcctcattaagttttcacgggccggaagcctgcgccgcgccaaagaaacggtgaaagacctcgattacattatggctgtcactgatccggaacttgtccgggaagggctcttaaagctttcgaacatcaaggaggtcattgccgcaggagatacgaaagtgtctctcacatttgcgtttgaatacgaaatcagtgcggatttccggctggtgacagaggaacagttcccaacgacgcttcatcattttaccggatcaaaagaccacaatatcaaaatgcgccagcttgccaaagaaaaaggcgaaagaatcagtgaatacggcgtcgaaaccgttgaaactggagaaattaaaactttctcaagcgaaaaagagtttttcgcccatttcgggcttccgtttattccgcccgaactgcgggagacaggaagagaagtcgaggactacagcgttgacatcggactcgtttccgccgaggatattcaaggagaccttcacatgcactcggcttggagcgacggtgctttttcgatcagggaaatggcggaagcatgcatggcaaaagggtaccgctatatggcgatcacagaccattcccaatatttaaaagtcgcaggcggtttgacgcctgagcgccttcgcatgcaggcgaaggaaattgatgaactgaataaggaatttaccgattttcatatttttaaaggcgtggaaatggacatcctgcctgacggaacactggattatgacgacgagctgctggcggaaatggatcttgtcattgcttccatccattcaagcttttcacagccgcagcatgtcatcatgaagcggcttgaaaccgcgctgctgaatcagcacgttgacattatcgctcatccgaccggccgtctgatcggaagaagggcggggtatgaagtcgatattgaccagctgatcgaacttgcgaaaaaaacgaatacagcattggagctgaacgcaaatccagcgcggctcgatctcagaatggagcacttgatcaaagcgaatgctgccggagtgacactcgttattaatacggatgcccacaacacagcgatgcttgatgatatgaaaacgggcgttacggcagcgagaaaaggatggacgccaaaggccaatgtattaaacacccgctcctttgaagaagtccaggcatttttgtcgcgccatcgatcttaaggaggtttaatggacgttgcagcaaaaagcgctatcagcacttgaatttcataaagtaaaagaacagctcacagagcatgcggcatcttctttggggaaggaaatgcttttggaactcaaaccttcccgttcgctcgaagaagttaaaaagctgcaggaagaagtcgatgaagcaggaaccgtcctgcgtttaaaaggaagcgcccctttcggcggccttacggacattagaaaagcgttaagaagggcagaaatcggcagcattttaagcccggcggaattgactgaaatatcgggtctgctatacgcagcaaaacagatgaagcactttcttgaaggcctgttcgaagacggggttgagattccttatcttcatcaatatgcagaaaagctcataccgctttccgaattggaaagggacatcaattcgtgcatcgatgatcatggggaagtgcttgatcatgcatcagagacgttaaggggaatcaggacccagctgcggacgcttgaatcaagaatcagggaccggctggaatcgatgctgcgttcttcatctgcgcaaaaaatgctgtcggatacgatcatcacgattcgcaacgaccgcttcgtcatccctgtcaaacaggagtacagatcaagctacggaggaatcgtgcacgatcagtcttcttccggtgcgacattgtttatcgagcctcaggcgattgtcgatatgaacaatgcgcttcgccaggcaaaagtaaacgaaaaacaggagattgaacggattttgcgcgtcctgacagaaaagacggcagagcacacaaatgagctctttcacgatgtcaaagtgcttcagacgctggactttatttttgcaaaagcaaaatatgcaaaagcgacaaaagcggttaaaccggctgtcaacgctgacggctatgtccgcctgattcaagcccgccacccgcttttgcccctggatgaggtcgttccgaatgatattgagctcggcggagagtatacgacaattgtcatcacgggcccgaacacgggggggaaaacggtgacgctcaaaacgctcgggcttttgaccatgatggcgcagtcgggattgcacgtaccggcggaagaaggatcagagaccgccgtatttgatcaagtatttgccgatatcggcgatgaacagtcaatcgaacaaagcttaagtacgttctcgtcgcatatggtcaacatcgtcgatattttgaaagacatgacggaaaacagccttgtgctttttgacgagctcggtgccggaacagacccgcaggaaggcgcggcccttgcgatcagcatccttgatgaggtgtgccagacaggcgcacgcgtcattgccacgacccattacccggagctgaaggcatacggctacaatcgcgaaaatgtcattaatgcaagcgtcgaatttgatatcgatacactatcaccgacatacaagcttttaattggagtgcccggccgaagcaatgcgttcgaaatctcgaagcgcctcgggctgcctgattacctgatcggccgcgcaaaagcggagatgacggccgaacataatgaagttgatacgatgatcgcatcgctggaagacagcaaaaagcgcgcagaagcggagctcaaggagaccgaagccatccgcgcggaagctgaagcccttcaccgcgacctgcagcagcagatcagcgaatggcaggagaaaaaagacaagctctacgaagaagcggagcaaaaagcggctgaaaaagtcaaagcagcgatgaaagaagcagacgacatcatccagtcgctccgcatgatcaaagaagaccataaagcatttaaagaccatgagctgatcgaggcgaaaaagcgccttgaagaagccgtgccttcgtttgaaaaagcgaaaaagccggctcagaaaaaaacggacaagcgcgaattaaaaccgggcgatgaagtcaaagttttaacctttggccaaaaagggacgctgctcgaaaaaacgggtgcggccgaatggaatgtgcaaatcggcatcctgaaaatgaaggtcaaggaaaaggatctggaattcctgaaatcggcacccgaacccgagaaacaaaaaacgatcgccgccgtcaaagggaaagattatcacgtctcgctcgaactcgaccttaggggggagcggtttgaaaatgcgcttcaccgggttgaaaaatacttggatgatgcggtgcttgcgggctatccgagagtctcgatcattcacggaaaaggaaccggcgccctccgaaaaggcgtccaggacctattgaaatcccaccgcaatgtgaaaaactcccggttcggcgaagcgggagagggaggatcaggagtcaccattgtcgaattaaaataataaagggagtctaaaaggatgaaagagttttgggagaacaaccttgtggaaatcgccgcgtactacagtgtttccgttttgtgtcttgtgatatttttatctgtgtttgaactcgtcaccacgtataaaaattgggaggagattcaaaaaggaaacatggcggttgcgatggcaacaggcggaaaaattttaggcatcgccaacgtgctgcaaaaatcgatcagccagcataattccctgctgcaaatgatggggtgggggctgttcggttttatcctgcttttgatcggctacttcatttttgaatttctgacgccgcgctttaaaattgacaaggagattgaaaacgacaaccgcgcagtcggcttcatttcattcgtcatttcagtaggcctgtcatttgtcgtggcttcgggtatctaaaggggatcaacatggagaaattagcgaaagtcctgttttttacagctggggtatttgtggttatcggcctgatttatatgatcttttatgcttgaaaaaggtgtcctaaaaaaggggcgcctttttaaaaatgaaaaaatatcattactttctgaatattgttttgatatactcaaatcaagaatatattgtttaaaaggggggagcttatgccgactgaaaaaccgtggctgcgtcattatcccgaacaaattcctcacgagctgcaatttgaagatcaaacactccattccatcctgcaacaatccgcccagcagttttcagaaaaaacagcgattcattttctaggaaaaaaacgttcgtaccgggaagtttacgaggatgctttaaaaatggcagattacctgctgtcgctcggcattcaaaaaggagacagagtatcgatcatgctgccgaactgcccgcaggcggttatcgcgtattacggcgttcttttctccggcggcatcgtcgtccagacaaatccgctgtatacggaaagggagcttgaacatctgcttcatgacagcggggcaaccatcatcattacgctcgacatgctgtacccggcggcatataaaatgaaagcgctaacaagcattaggcacatcattgcgacaagcataaaagattacctgcctttccctaaaaatctgctgtacccgatcgttcaaaaaaaagagaatcaaatgtccgttgagatcaatgaaaatgagacgacccaccttttccgcaccatcatgaaacgccccgttccaagcggaccgcccggtattgaaattgatccggcccacgacattgccgtcctgcagtataccggaggaacgacaggcacgccaaaaggcgtcatgctcagccaccgcaacatactagccaacatggagatgtgcgccgcctggttttatcaattgaataaaggggaggagaaggtgctggggatcgttccgttttttcacgtctacggaatgacggccgtcttgaatttcacgatcaggcaggggtatgaaatgatcctgctgccgagatttgacgcgcgcgcagcgctgaaaacgatcgataaagaaaagccgacgatatttccgggggcgccgacgatttatatcgccctgttgaaccatcccgaccttcaccaatacgatctgtcatcgattaagagctgtttgagcggatctgcggcgcttcctgttgaagtcaaacagcagtttgaaaaggtgacgggcggaaggcttgtcgaaggttatggaatgtctgaaacgtcgccggtcactcacgccaattttatttgggatttgaataaagcgggcagtatcgggtgtccttggcctggtacagacgctgctatctattcggaagaaaccggcggttttctcgggccttatgagcatggagaaatcgccgtcaaaggaccgcaggtgatgaaaggctactggaacaatgatgaagaaaccgctcagagtctaagggacggctggttttttaccggagacatcggctacatggataaagacggcttcttttatatcgtcgaccgcaaaaaagacgtgatcattgccgggggatacaacatctacccgcgcgaaatcgaagaagtgctctacgagcatgaagcagttcaggaggcggtcgttgccggcatccctgatgaatacaggggggaaacggttaaggcttttgttgtgctgaaagatcatgttacaataacggagaaggaattggacgaatatgccagatcgcgtctcgctccttataaagtgccaaaagtatacgagttcagggacgaacttccgaaaacggcggtcggaaagattttaagaagagcgctcgttcaagaggaaaagaccggcgtctgaaaaagcaaagtctgccgtcgattttgacggcatgcttttgtgatgcgatttacttttagcttcttgacaaagcgtccatttttatttacgattaactcatgaatgagtattcattcattaatttgaaaggaacgaagccaattgaaacaaaagagaccaaagtatatgcagattatcgacgcagctgtcattgtgattgcagaaaacggataccatcaggcgcaggtttcaaaaatcgccaagcaggccggggtggcggacggcaccatttatctttattttaaaaacaaagaagacattctcatctcattattcaaagagaaaatgggacagtttatcgagcagatgagcgaagaaatgacagcgaaaaattcggcgacagaaaagctttcgctgttcatcaaaaagcactttgaactgctcagcagcgatcgccacctcgcgattgtcacccagcttgagctgaggcagtcgaatcttgagctgaggctgaaaatcaatgagattctcaaagggtacttaacgatcctggaagacatcatcaccgaaggaaaagaagctggagaatttaaaagcacgcttgacgtccgccttgcgaagcagatgattttcggtacggtggatgagacggttacaacctgggtgatgaatgatcaaaaatacgatctcccaaacctggcagacagcattcatgaattgctgatccacgggttcagcagccaaaagacgaaggaggaggaataaaaatggcagcattatcatacgccgtagacggccatgttgcgacgattacgattcagcacccgccggcaaatgcgctatcgacgcaagtgcttgaagatctttctgcatgccttgatgaactttcagaacgtcaggatgtcagaagcgtcgttattcacggggaaggaagatttttctcggcaggcgctgatattaaagagtttacatcattgatggacgggtctgattatgcaaatttggctgataagggccagcagattttcgaaaaagtagaatcttttccaaaaccggtgatcgccgcgattcacggggccgctcttggaggcggtcttgagctagcgatggcatgccacatccggattgccgaggaaagcgcaaagctcggccttcccgaactgaatctcggaatcattcccggctttgcgggaacgcagcgccttcccaagtatgtgggcaccgccaaagcgcttgaaatgatcgggacatcagagccgatatccggcaaggaagcttttgaatacggtcttgtcacgattttggcggcgaatgaagaagaagtgctgcaaaaggcaaaagagctcgcacaaaaattcgctgaaaaaagtccgcagacgatggcttatgtcattgaactcctgaattcgagcaaagtgtattcgtatgaaggaggcctcaagctagaagggaaatacttcggcgaagtgttccaatccgaggatgcgaaggaagggattcaggcatttcttgaaaagcggaagccgcattttaaagggaaataacaaacgtgaaaacaaaggggatgaacagaacatgaacatttatgtcttaatgaagcgcacgtttgatacagaggagaaaattcagatcgaacaaggggaaatcaacacggacggagcggaattcatcatcaatccgtacgatgagtacgccattgaagaagcgctccagttgaaagagaagcacggcggtgaaattacggtcgtgacagtcggcgaggaagaagctgaaaaagaactcaggacggctctggcgatggggtgcgacaaagccgttctgatcaacattgaagacgacgtggaagaagcggaccaatatacggcttcagccatcctttacaactatttgaaagaccgcgagtacgacattatactcggcgggaatgtggcgatcgacgggggatcgggacaggttgcgcctcgtttggccgaactgctgggcattccttgtattacgacgattacaaagctgacggtaaacggcggagatgttgaagcggaacgcgacgccgagggcgatcttgaagtgatccaaacatcgcttccaatcgtagcgactgcacagcaggggttgaacgagccgcgttatccgtctcttccgggaatcatgaaggcaaagaaaaagcctctcgaggagcttgagcttgatgatctcgacatcgacgaagaagacgtggctgcgaaaacaaaaacgatcgaacggttcctgcctccgaaaaaagaagccgggaaaatccttgaaggggagccggagcagcaggcggcagaacttgtatcactgctgagaagcgaagcaaaggtcgtatgaagccgaagggagaaataacacggtcattaaaatacagggggaaatggacatgagcaaaaaagttatcgtattgggagagttcagagacggttcgttgaggaatgtgactttcgaagcgatagccgcaggaaaaacggttgccgaagggggagaggtgatcggcgtactgttcggtgaaagcgtttcaagtcatgcggcagaactgatccattacggcgctgacagagtgcttacagccgaaaacccgctcttgaaaaactatacgtctgacggctatgttcaagccttgttgccgatcatagaacgcgagaatccggacgtcatcattttcggacatacgtcaatgggaaaagacttgtcgccgaagctttcagcccgtatgggaacagggctgatatcggatgccgtcgatgtcgaagtggccggcggcaacatcgtgtttacaaggccgatttactcgggcaaagcgtttgaacggatcatttccgaagatgaaacgatttttgcaacgatcagaccgaataatatcgccccgcttgacaaagatgagacgcggacaggagcggtcgaaagcatcgaagcagatattcgggacatcagaacggtcatcaaggatattgtcaaaaaaacgtccgaaggcgtcgatttgtctgaagcgaaaattatcgtagccggcggtcgcggcgtcaaaagcgaggaaggctttaaaccgctgcagaagctcgccgatgtattgggcggggcggtcggcgcttcaaggggagcctgtgacgcagactactgcgactattcgcttcaaatcggccagaccggcaaagttgtgacacctgacttatatatcgcctgcggcatttcaggagcgattcagcacctcgcagggatgtcaaacagcaaaatcatcgttgccatcaacaaagatccggaagctgatatatttaaaattgccgactacgggatcgtcggcgacttatttgaaatcgttccgctgctcacggaggaatttaaaaagctgagcgtcagcacatgatcaaaagccggcctgaaatggccggcttttgacataggcacatttccgccttctgcaaaataacatgggatatggacattttcagaaaggctaaaatcccgatgtgtaaaactgtgcagatagggaaacgtataatcaagcattatgttagcgtgaaccaaagggagatgctatactaaaaagcataatttcacaattggaggaatgaaagaatggctatcgtaaaagcaactgatcaaacattctcatctgaaacaagcgaaggcgtagttcttgccgacttttgggctccttggtgcggaccttgtaaaatgatcgcgccggtacttgaagagcttgatcaagaaatgggagacaaactgaaaatcgtaaaaatcgatgttgacgaaaaccaagaaactgccggcaaatacggcgtgatgagcatcccgactctcctcgtactaaaagacggcgaagtggtcgaaacatctgtcggctttaaaccgaaagaagcgcttgaagaactggtcaacaaacatttgtaaaatagaaacctgtgaaaaaggcgattccaaagggatcgcttttttcttacaagtcatcttctttctccatttgtggcgaacgtacggtcggtcatggtaaacttaaatgaaggaaaaacgccgaaataaggaaggatttttgatgaacaaaaaaatcaaagaaaagctggcccttcttccggatcagcctggctgctacttgatgaaagacaggcaggataccgtcatctacgtcgggaaagcgaaaatcttaaaaaacagggtccgctcctatttcagcgggtcccatgatgccaaaacacagcgtcttgtcagtgaaattgaagacttcgaatacattgtcacatcctcgaacatcgaagcgctcattcttgaaatgaatttaatcaaaaagtacgacccgaaatataacgtgatgcttaaagatgataaaagctacccgttcattaaaatcacgaacgagcggcatccgaagctgattgtcacaaggaaggtcaaaaaagacaaaggccgctatttcgggccgtaccccaatgtccaggctgcgagggaaacaaaaaagctgctggaccgcctctatccgctcagaaagtgcgccaagctgcctgaccgcgtctgtttgtactatcatctcggacaatgtctggcgccatgcgtatatgatgtgtctgaagagacaaacagacagctcacagaagaaattacccgctttttaaaaggcggctacaatgaagtgaagaaagagcttgaagcaaaaatgctcgaagcctcggaaaacctgcagtttgaacgggcgaaagaattccgcgatcaaattgcccatatcgagtcaacgatggaaaaacagaaaatgatgctgaatgacatggttgaccgcgatgtatttgcctattcgtatgacaagggctggatgtgcgtccaggtcttcttcatcaggcagggcaaattgattgaaagagatgtcagcatgtttcctttatacagggaagcagacgaggaatttctgacattcatcgggcaattttactccaaaaacaaccattttcttccgaaggaaattttggtgcctgacagcgtcgacaaggacatgattgaggagcttttggacgtgaacgtgcgccagccgaaaagaggagcgaaaaaagacctgctgctccttgcccataaaaatgcaaagctcgctttgaaggagaagttttcgctcattgaacgggatgaagagcggacgatcggcgcgattgaaaagctcggaaaagcgctggacatctacacgccatacagaattgaagcgtttgataactcaaatattcaaggaacggaccctgtttcggccatggttgtatttctcgatggaaaaccgcataaaaaagagtaccgcaaatataagatcaagacggttgaaggtcctgacgactacggatcaatgcgcgaagtcatcagaagaagatatacaagggtgctgaaagagaatctgccgctgcctgatttaattttgatcgacggcggaaaggggcaggtgtctgccgcccttgacgttctggaaaatgaactgggtctcgatgtccctgttgccggtctggtgaaagacgataagcacagaacatccaaccttttgatcggcgatccccttgagatcgtccagcttgagcggaacagccaggaattttacctgcttcagcgcattcaggacgaagtgcacaggtttgcgatcagcttccacaggcagctcaggggaaaaagcgcatttcaatcggtgctggacggcataccgggcgtcggcgaacagcggaaaaaactgctgttaaaacatttcggttccgttaagaaaatgaaggaagcgagcgccgaagatatccgcaagctcggcatacctctgaaaacggcgcagctgatcgaagaggcattgaaaaaataatgttgaacttttaaaaagaatctgatagaatttgtactaatttcataataagatcgtgtgatatggtgaagatagaggtgcgaacttcaagagtaggcttgatgaggaagatggattccgatgaagaaagccgaaaggggagcgtcgccgaagcggggaaaaatccactcgtttttcctgctggctttacattgaataaatgtgaggctgtcaagaaatcatttcttggagagctatctcgttgtttaagatcatcggcatttttgttggttaaagcaatgagggaattctctcgttgctttttttgtgcaaaaaaaaccgtacaggccgccggtcaagctttcctcttcatacataaacaaacacgaacgaaaacaaaaagggtggtatttgatgggtctcatcgtccaaaaatttggcggaacttccgtagggtcagtggaaaaaatattgaatgtcgcaaaccgcgtcatcgaagaaaaacagcgcggtcatgatgttgtcgtcgtcgtttcggcgatgggcaaatcgacggactccctcgtcgcgcttgccaaggaaatcaccgagcagccgagcagcagggaaatggacatgctgctgacaacaggagagcaggtgacgatttcgctgttgacaatggctttgcagaacaaggggtatgatgcggtttcctatacaggctggcaggccggcatcgaaaccgaaaatattcacggcaacgcaagaattacgaacattgatacagccaagctgaaagagcgcctgaatgaagggaaaatcgccgttgtcgccggattccagggcgtcacagcggaaggcgaaatcacaacgctcggcagaggcggatcagatacgacagccgttgccctcgcagcagccctgaaagctgataaatgcgacatttacaccgatgtgccgggggttttcacgacggatccccgctatgtgaaaacagcgcggaagctggccggaatctcctacgatgaaatgctggagcttgccaatcttggagcaggcgtccttcatccgagagctgttgaatttgcgaaaaactaccaggtgcctttggaagtccgttcaagcaccgaaaaagaagccggcacattaatcgaggaggaatcatcaatggaacagaatttaatcgtaagaggcattgcatttgaagatcagatcacacgcgtgaccgtatgcggcctggcgagcggcctgacgacgctgtcaacgatttttacaacgctcgccaaacagaacatcaacgttgacatcatcattcaatcggtgacaggcacaagcaaaacgtcgatttctttctcagtgaaaacggaagacttaaaacggacggttgaagttctagaagaatacaaagacgcgctcgactatgaacagattgaaacggaaaacaggcttgccaaagtgtcgatcgtcggttctggcatgatctccaacccgggagtagcagcggaaatgttcgctgtgctggcggaaaaaaacatccaggtcaaaatggtcagcacatccgaaatcaaagtttcgactgtcgtcaacgaaggcgatatggtgaaagccgttgaagcgctgcatgatgcttttgaactgtcgaagcagacagcagtcatttaaaaagaaaaaggcgggacttttgcagtctccgcctttttgcatagttatgccgggtctttcaaatcccatttcaccgttaaaaccacttttccggctctttttttcacctgttcataagattcggcaatttgttcgttcatcagctggatttgctcggcgataaacccggcttcaagctgaaagcagggctccttttgatacttgaggcggtttgaaaccagcgggccttcgagttcaaactcaagctcctgtttttttgaatggacgatcgcaagcgttccccagcctgcatcctgaaagaaagcgggaagatcctcccgggattcaagcgggaacttgcgggcgagcttttttcccgcccagtacatcatatctgcgtagtcttgtcccagcatatcgggaagcagcacttccctgatcaactcatagccatatgcggagacttccagctcttttaattgcgctaagtttgcttcatatttattcatatccaatgtctcccctcttttctccgtttattatagcttaaatggggtgaaagattacagcggagacatgcatttaggaagaaaaaaatctgatatatttatattttgataaaataaaattttcaaaaatatgattaaattttagaaaatttcaatttatgtacgcgttttcttgacgcctatttctcataggagtaaaatgaaattgtcataaaaacttaacaaagtgcgatatttgaaacaggacgggggataggagacctttcatttttactgcacttttcaactagggggtaaagcaatggccgggaacagagagtttgtttatcgaagactgcattctttgcttggcgtcataccggtgggcatatttttaatccagcatttggttgtcaaccattttgcggcaagcggagaagaggcgtttaataacgccgctcactttatggaaaacctgccgttcaggtacgctttggaaatcttcgtgattttccttccgctgatttatcatgctgtttatggagtatacatagcttttacagcgaaaaacaatgcgaacagattcggcttttttagaaactggatgttcgttctgcagcggattacaggaatcattaccttgatttttgtcagctggcacgtgtgggaaacacggattgccgcccaaatgggggcagaggtgaactttgacatgatggctgatattttgagctccccgatcatgctcggcttttacattgtaggtgtcctctcaacaatcttccacttttcaaacggtttatggtcgtttgctgtcacttggggaatcactgtttctcctcgctcacagcgaatcgccacgtttgtgacaatgggagtctttgttgtgctgtcctatgtagggctgagagcgattttggcatttgtgtaaaagaactagattactagagggagtggggcaggcatgagcaattcaagcatcatcgttgtcggcggaggactagcgggtctgatggcgaccattaaagctgcggaagcaggaacaaatgtaaaactattttcgatcgttcccgttaagcgctcacattccgtatgtgcgcagggcggaatcaacggagcggtcaatacaaaaggtgaaggagactccccatgggagcattttgacgacacggtgtacggaggcgactttctggcgaaccagccgccggtcaaagcgatgtgtgaagcggcgccgtcgatcattcatttgcttgaccgcatgggcgtcatgtttaacagaacgcctgaagggctgcttgacttccggcgcttcggaggaacccagcatcacagaacggcatatgcgggggcgacgaccggacagcagctcttgtacgcgctggatgagcaggttcgccgcttcgaagttgaagggctcgtttcgaaatatgaaggctgggagtttctcggagccgttcttgatgatgacaatacgtgcaggggcatcgtcgcccaaaacttaacgacgatggaaatcgagtcgttccgttcggacgcagtcatcatggcgaccgggggaccgggcatcatcttcggaaaatcgacgaactcgatgatcaataccggatcagccgcttcgatcgtttaccagcagggtgcttactatgcgaacggagagttcatccagatccatccgaccgccattcctggagacgacaagctgcggctgatgagcgaatcggcgcgcggtgaaggcggacgagtctggacgtataaagacggcaagccttggtatttcctcgaagagaaatatccggcatatggaaaccttgtgccgcgtgatattgcgacgcgtgaaatatttgatgtgtgcgtcagacaaaagctcggcatcaacggcgaaaacatggtttatctcgatctttcccacaaagatccgaaggaattggacatcaagctgggcggaatcattgaaatctatgaaaaattcatgggtgacgatccgcgcaagctgccgatgaaaatcttccctgcggttcactactcaatgggcggactttgggtcgactacgatcagatgaccaacattcctggactgtttgccgcgggagaatgcgactattcgatgcacggcggaaaccgcctgggagcgaactcgctcttgtcagccatttacggcggcatggtggcaggtccgaaagccgttgaatacattcaaggtctcgaaacatccgcagaagatctgtcttcttccgttttcgatgcatacgtcaaaaaggaagaagaaaagtgggctgacataatgaaaatggacggcaatgaaaatgcttatgtccttcataaagagctcggcgaatggatgacagacaacgtgacggtcgtgcgctacaatgacaagctgctgaaaacggatgaaaaaatccaagagcttgccgagcgctaccgaaacatcaatatcaacgatacggcaaaatggagcaaccagggcgccgtattcacgcgccagctgcacaacatgctgcaattggcacgggtgatcacgctcggtgcatacaaccggaatgagagccgcggcgcccattataaaccggatttccctgaacgtaatgacgaggaatggctgaaaacaacaatggcgaaacatgcaggcgattttgaagccccgaaattccattatgaggatgtcgatgtttcattaatcgcaccgcgtaaacgggattactcgaagaaaaaggtggcgaaatcatgagtgaaaataagacaatcaagtttatcatcactcgtcaggatacatcggattctaatccttaccaggaagagtttgaaattccataccgtccgaatatgaacgtgatttccgctttgatggaaatcagaaggaacccggtgaatgcaaagggagaaaaaacgtcgccgattgcttgggatatgaactgtctcgaggaagtgtgcggcgcttgctctatggtgatcaacggcaagccgagacagtcctgtacagcgctgatcgaccagcttgagcagccgatccgccttgaaccgatgaaaacattcccggttgtccgcgaccttcaagtggatcggagccgcatgtttgattcgttaaagaaagtcaaagcatgggtgccgatcgacggcacatatgatctcggaccgggaccgagaatgcctgaaagaagacgtcagtgggcttatgagctgtcaaaatgcatgacttgcggcgtgtgtcttgaagcttgtccgaacgtgaacgataaaacaaactttatgggacctgcaccgctctcgcaagttcgcttattcaacacccatccgacgggagcgatgaacaaatctgaacggcttgaagcgattatgggagacggcggactggccgaatgcggcaactcgcaaaactgcgtgcagtcgtgtccgaaaggcatcccgctcacaacctcaatcgctgcattaaacagggatacgaccgttcaggcgtttaaaaacttcttcggaagcgacaacacggaataacacgaaaaaacgcacctcttcaaaccgaagaggtgttttcatgatcaaaggggatgaaaacattgaaattgccgggatatatcgaagaaccgtttgacacatggtgtcagtcattttctttttttgatgaagtttccgtccgtttttcagaaacggacatgttcggtcatatgaacaatgtcacaccgtttgtctacttcgaagaagcgaggatttcctatttcaagcacctgggcgtcatggaccgcctttcagacgggaagagcgcggccattcccgtcgtggcgagccagcaatgcgactattttcagcaggtcatgcttcatgaacgtttaaaaatcggcgtcaaaacagcatctgtcggcaacgcctcgctcaccctccattacgcagcgaaaaatggggaaggcggcctttgctttacaggactggcggttatggtgcaaattgcgaaagatacgggtaaacccgtgaaatggacagacgaacaaaaagcaaaactgcttggcaataactcatttcctgagaaataattgacagggagaggaaaatgaaaaaagcgataatcatcggcgcgagttccggaattggcaatgcgcttgccaagcagctgtcagccggaggagtggaggtcggtcttgctgcaagacggtatgagctgctagccaaattgcgcgacgacctccctggaccttcatacattaaaaagatcgatacagccgacagcgaacactcgcctatactgttgaaagaactgcttgatgagatgaatggggcagacgcagtcttcatctgttcaggtgttggatatttggaaagcgaaatggattggagcaaagaaaaggaaatgatcgatgtcaatgtgacgggatttgtgtcctgctcgaacgtgttgatggagcattttatcaaaaacgggagagggcatttagtcggcatttcatccatcgccgcgctgagaggaaacggagggaccgtcacctacgccgcttcaaaagcattcgtttcaaattatttaaaaggacttcgtcaaaaagtgaaaaaactcggttgcgatgaaattgcggtcaccgaaattcagcccggcttcgtggacacggctcttgcaaaaggtgatcatctgttttggacggcttcgcccgaaaaagcggctgcacaaatcatcagcgctgtgcagaagaagaagacgcacgcatatattacgaagagatggcggctgatctcctggattttaaaatgtcttccttagaagttcagccctgaaacgatgcctgtgtcatgatttgaaaaataggtgtttgagggaacccttttctccgtcagaaacgtcaccgaccttgcgtatgtttcatatgatatcacgactatatttgaaacccattcgtttcagatcagctctcaccttagcaaggagggttacaatacttgaaggagaaagagtttcaatcaaagccgctgctaacaaaaagagaaagagaagtgttcgaattgctcgttcaagacaagacaacaaaggaaatcgcaagcgagctctttataagtgaaaagactgtacgtaatcacatttccaatgcaatgcaaaaattgggagtgaaaggccgttcgcaagctgttgttgaacttcttcgaatgggtgagctagagctctaaattgagccggtgttccttcttgtatcaagaagggaaccggttatttgttttttcaagagcaatttgtatattcatgttgaagtcttgcaatttgtgtagaaaagaaggaaaatagactcaagtgttttgaaaacaaaacaacgagtcgagcgaggtagagaaaatgaattcgaatgcttctttgaatcacatagcggacattgaaaaatcactccgccatattgcgggcatcattaaacaaaaaggaagagaaattctcacccaatatacgattacccctccccagtttgtcggtcttcaatggctgtatgaatacggggatatgacgatcggcgagttatcacaaaagatgtacctggcgtgcagcaccacaacggatttaattgaccgaatggagaaaaacaacctcgttgaacgggttaaagatccgtccgacaggcgcgtagtccgcattcatcttctatcggaaggagagcggatcatccaggaggtcattcaaaaaaggcaggactatttagaagacatgttagaggcgttttccgaggaagaaacagccgcgtttgaaaaattattaattaaacttcagcaggaaatgaacagaaaatgaggcgattttgttggatcaaccgataggagtcattgattcgggagtcggcggtttaaccgttgcaaaagaaatcatgaggcagctgccgaaagaaaaaattatatatcttggagacacgaaaaggtgtccatacggaccgagggacagaaaagaagtcctgtcatatacatgggaaatgacaaattatctgttatcccgccaccatattaaaatgctcgtgatcgcctgcaatacagcaacggccatcgcgctagaggaaatcagcagggaagttgcgatacccgtcatcggcgtggtgcagcccggagccagaaccgcgattaaagtgacggaaaaccagcgaatcggcgtaatcggaacggaaaacacgatcaaaagcggcgcatacgaagaagcgcttctttcgctgaacggagatttaacggtggaaaatctggcttgcccaatgtttgtcccgtttgtggaaagcggcaaatttttggatgagacggctgatgaaatcgtcaggacgtcactgcacccgctcagagattcatcaatcgatacgctgattctcggatgtacgcattatccgattttaaaagagccgattcagcgctatatgggagagcgcgtcaacatcatttcctccggagatgaaacggccagggaagtcagcacgatcttgtcatacaacggtttattaagcaaaacggcggaaccgccggaacacttgtttttaacaactggggagcgtgcccgcttcacaaaaattgcaaacgattggtttggatacgaagtgaaaaatgtggaaagcatttctcttcaggagaccgctgtaaaataaagctgccgcacatgcaaacggcagcttttttcatggccttttcttttaaagaaaaggttttttgtattcagagggatttttttaaaaagcggtctaattcaaaaacgggctcgtatacataatagtacaaactgccttaggagggaaaagtatgctgaaaaaaggaatgaaaggaatcgcggttacggttacggcctccgcgctgcttctttccgggtgcggaatatttcagtcagatcaagcctcagaggagatagatccgccgcaggacatcacatatgtaaaagaggagaaggagcaagacaaaacagacaaaaccaaagataaaacagaagacaaaggcagcaaaacgacaagcgacgataaagccgctcaaacgggcgatacggtcatgagagagctttatctcattgataagaacggctatgtgacagcgcagacgctgccgctgccaaagcaggaagggacggctaaacaagcgcttgaatacctcgttgaaggcggccctgtttcaaacatcctgccaaacggattcagagccgtgctgccggcggatacaacggtcaatgttgatattaaagaagacggaacagcgatcgctgatttctcaaatgaatttaaaaactataaagctgaagatgagcaaaaaatcgtacaggcgattacatggacgttaacgcagtttaactcgattgataaagtgaagctccgcatgaacggccatgatttgaaagaaatgcctgttaacggcacgccgatttcagaagaactcagccgcgaggacggcattaacctcgacacggcgggtgtgacagatataacggcgacacagccggtcaccgtctattatttggctgaatcagataaaggcacatattacgttccggtgacaaagcggacgtctgcaaaagaaaaagatcaggtgacggcggcgattaaagagctgactgaaggaccggacaataaaagcggcctgctctccgatttccagggcgacgtcaagcttgaaaacaagccgaagattgaagacggccatgtaaccctcgactttaacgaagcgatctacggaagtgccgacggccagaaaaaagtgatatcggatgaagtgttaaacagtatcgtgttgacattaaccgaactgcctgatgtgaaaagtgtgtcggttaccgtgaacggaaaatccgagctcgtgaatgaaaaaggagaaaagctttccaagccggtttcaagaccgagcaaggtgaacacaggtagtttttaagccgaaatttttgatatactatagaaaaagaggtgagcgatcaaagctgcctctttctttattcagctttttggaagagcggaatgattgtgaaaggtttatgtacatacaatcggaggtaaaaaatgagatacgatggaagaaaaaacaatgaactgcgccctgtcacaatggacctcgactttattacgcatcccgaaggatcggtcctgattacagtcggcgggacaaaggtgatatgcaacgcgtctgtggaagaccgcgtaccgccctttttgagaggagaagggaagggctggatcaccgcggaatacagcatgctgccgcgggccacgaaccaaaggacgatcagggaatcgtcaaaagggaaaatctccgggcggacgatggaaatccaacggctgatcggacgagctcttcgggcggttgttgatttggaaaagctcggtgagcggacgatctggatcgactgcgacgtcattcaggcggacggaggtacgagaactgcgtcgattaccggagcattcaccgccatggcgcttgccgtcggaagactcgtcgaaaaaggcgcgctgaaggagatgccgatcaccgactttttggctgccacttcagtgggcatcgataaggaaaaaggattgatccttgatttgaactaccaggaagattctgcagctgaggttgatatgaacgtcgtcatgacaggcgaaggccgctttgtcgaacttcagggaacaggagaggaagcgacattctcaagaagtgaactggacgggcttttagagctggctgaaaaagggatcgccgaactcatcgaaaagcagaaagaagtgctcggcgacgttgcattatctattcaacaataacatgagaaaggctgatacacgatgaaggaagtcatcattgccacgaaaaacgaagggaaagtcagggaattcaaagcgatgcttgaaccgaggggctacgatgtcaaatctttactggacatcggctatacacccgaaatcgaagaaaccgggcagacttttgaagaaaacgctgtgattaaagcggaaacaatttcgaaagaaaccggaaaaatcgtgattgccgacgactccggcctgtctgtcgactatctcggcggcagccccggcgtatactcggcccgctatgcaggagaagagaaaaacgatctcgccaatctgaaaaagctattgaaagagctcgaaggggtggaaaaagaagaccgttccgcgaggttcagatgcgcgctcgcaatatgcattcccggacaggaaacgaaaacggtcgaaggttctgtggaagggtacattaccgaagagccgcgcggcacaaacggcttcggctacgacccggtttttctcgtcaaagacaaagatcaaacgatggccgagctctcaagcggcgaaaagaacaaaatcagccacagagcggaagcgctgaaaaagctgtccgctttattggatcaagcgtaaaggaggagggccgatcatgaaggttctgattgtcagcgacagccacggccttgaagacgaactggaaatgatcgctgagcggcacgggaaggaaacagatctcatcatccattgcggggattctgaattggacccttcccatcccgcgctttcctcttacttaacggtaaaaggaaactgcgatttttacggggagttcaaagacgaaatcgtcgttcccgccggatcgagaaagctttttttcacacacgggcatttatacggcattaaacagtcgcttttaaatgtgtactgccgggctgaagagctcggcgccgatatcatctgtttcggccattcccacatcgcgggaagcgagctgatggacggaaaactgctgatcaaccccggcagcatccgccttccgcgggtgcggaaagaaaaaacttatgctatactaaacattgacaaagacaatgcaacggttcgctattatgacttggacggccgggaagtcgaaagcctgacgaaccatgtacaattgccagcacattcatgaggaagaatttttttcttcctcgtgaagaaaaaaattctaaaaagttgttgactttatgtcccgatccgcatataataaatcttgtcgctgatagttaaagcgaaacaaaacaacatcatgtcccagtagctcagctggatagagcaacggccttctaagccgtcggtcgggagttcgaatctctcctgggacgtcacgtaatggggcgataaagcccgtcatcatacgctttctactcgttaaatgtaacggtcaatgtatcggtcaattaaaaaaccgacgcaattttgaaccgttcaatttaacgaagtaggaggcgttttttgttgacgaaaaagaaaccgattttcacaatcgacgaagatttttccgatttgactacggcgcagaagcctccggtaaatacgccgaaaaagcgagtgagggatcgaattaccatcgaaatgaaattatttgagagaaacaacaattaagtctgatggattcaggaatttatattggtccaagacggagagcctgcggacaccaaattgacgttgtatatacgtttattggtgtctaatttgtttttaggagggatttagcatgtcagctacacaactgactttttctgccgcctatagacgaaaaagaagtcagaaatacgattataagggagctaaaaagatataaggctttaaaggttcagcttgaaaaccggaaagaacgggaagcggccgggatgaataaccttttcccgcagctcagggatcagcactctttaaatgaattgaaagtttgtcagatggacagggcgcttaaacaaagccttgatggtgatgaattaaagatcataaaggccaagtatctctctccccaaaaaataaaggacattgagatttatatggagatggggttgaaaaaggacaaatgctatcaggtcaaacggcgggccatttacaatcttgcgacagctctcgggataatctgagggctgttgtgaacaaaaaagcagactcccaggagtccgctttatcaaagtgtacttttttaatcttaagggccgaactgaatcacgttatgatttaaccaaaaaacgcattttcagcaactttaaagtctccagtaccgaattcagcttttccttgagtagtaaagtttaaaataccagttaaaaatacacctgttattactgcacctaaaagtaattttttcatgagacaagttcctccgtccatgtttgaattttgtcgcgagcgactactccttcatcgaagtatttcgccgctaattcatgatattccttctttttgaagtgtcttgctgcaatgatagctaaatctgctacgtctgaccaaagctttttgtctcttagcatattcaatcctttatctaataaggtcttatccaactctttatatattgagtgtatgactaataacttggcttcgtacgttttttcgtttatttcttttgcgagattgagggctttttgataccaatgtgtcccttcttcgaataaacctttcttgaataaaacccttgccagcatataagaagttctgatgattgcgattttggaatgtagattttcaaaaatgtcgagagctatttcgaaggattcacgcgctaaatcgagtttttcttgtcgttcgtaagcaagaccgagattgtgatgtccgagtccctcaacgtaattttgtcgggtatcagcagccatttttattgcttttttatatacggactcagttaattcgtattgatgtagatccagtctgtttgccgcaattatcatttgagtggttgctgccctattttcataatttccaagggctaaaaagctttcgagcgctttttctgcgtgtgttaacgagaaaaaattttggtgaatttcataatatgcaatagcaatttgataattgaattctgctcgttctgcttcgtctggtattttatttatccaattttcagcaatgcgataaaaattaatggctttcgtaaagttctttatgtaaaactgatacagcccgatgaaaaagtaaaagtaatactgaagcatgtcgtccgtcttcttttcttcagctctatacttaagactttttaagatgctttcggattcgttatatttttcgatcaataatttataccgagaatctatcatattgaaataaagcaaaacatcttgattcttctccatattatcaatagccttctgaatttctttcttcatttgagttgctttatgaacttgctgtaacttaattgttgcataccattgattcaacatattcccgaccttttcggatcgtattttaacaaccaattcccaccattcctttcgtataattgatttgaaatattcaaaaaaataagtatccatttcctttttctgcatacctttcattttacagaaaggatcatttttttacaatgattttccttttttggaattcaaaaaaagcctgtcgactgtgttgggttttaagacctgatcaataagattcattttcatggatagacaggatttattcaccaatttctttccgtaaagtggtaaaatctatactgattgtaactttagtattagaggggaatgccatgaagactcttgatgtccatgcgttgcaccatgcaattgatcaaacgctggaacaattaaaacagcagtcagacgaattatccaaagtcaaaaaagccgtagagggcattacatcacttgatgatgctttaaaaggaaaaggcggcgacgcgatccgcgccttttacgaggaatgccacaccccttttctacagttctatgatactttcatagaggaatacagttccacgctgaagaaaatgaaaagcgcgctgaattcgctggaaccaaaccacaacgggtttatttcgcaaagctttcttgagcacgagctggaacaaggattgaatgcggccgaccgcactacgaagcgtttggtttctaaaacaaatgccacgatcgcaaaagtcagccacattgtcgatttgcctgatttgaatgacagcggttttcacgaacagaatcagaaagctttaaaggaaatcaatcagacaattgaaaagctgcacgccttcgaccgcgaacagacaagcgctcttaaaaccgctgaaaacgacctggaaacgatgcagagatacataagccggcttgaaaaaatgtacacaggccctaaaattgaaattaccggttaccaaaaaggctcgattttaaagccggatgagatggatgctttacgtggtggacaagacacagcgatgggcgtcatgttggataagctggataagagatcaaagcttgaaaaagaggccagcaaaatagaacctatgagtcatactgatacgttgaagaaaaaacttgaaaagttgtatgatgatccggatgagtttctcaaagttgctagagagattggatatgataatcttacatctgaacagatgaattatgttactgccattgaagaagcttatgagttcagagcagatccaattaaaggaactctggaagatggaaaacatgtcttagaaagtatgaaaggctttgtggttggaggatatgaatttgcaaaagatacgatccaaggaacgattgaaacaggtaaagctcttattggacaagcagacgactttattaaaaacccaaaagcaactgtaaattcagtacttgagtatgattacaaagccgctttcgaaagtatgttgcaatcaatcgcagattcgtgggacgaaaaaatggtacatggggattcatattctcgcggacactatattgcttatgcgattgggacgatatgggggttggcagaggccggtcctactgtcgtatcaggctcaaaaagtcttggcaaagctggcaaggctgcagcccaaacagcaaagaaaagtgttaactctgttaaacaacatttcagcccgcctaaaaatcgctatactcctgcattagaagggatgctccaaagagcgggagaggcccctaatgtgaaaaatacgcctttgctgaaggagctgcttgaggataaaaagaaaagtgtgcttttcaaatcaatcgataagaatggtgactttgtgggctccttaaaaggagaacagatccatctgaaaaatgtgaaagttaaagaaataagctatactaaaagagatcctgcagagacaaaaaaacttagaagcacttttaatggctctgttaaaaagaagtttttaaaaagcctagttaatgaccctcaaaaattgaaacagcttaagaacgccggtttgtctgattcagatatagcaagaatgcaggatggattaaatccaaaaggttggcaagttcatcataaacttccattagatgatgggggtacaaattctatggataacttaattttaatgaaaaacgatcctttccataaagcaattactaatgagcagaatgctttaacaagaggattgactcctggacaaacaaagaaaataaaaaactggccaataccaagtggggaaatttatcctattgaaaagtaacgggagggaagtcttaatgtggaaagcgcatttagaagagattcggaaaatagagaaaaaatatggagatgatctcaataaaccagcctctattgacgccataaaagaactggaacaaagcgttcaagaaaaattttatagtgcagtgctacctgagggatataaacagttcctcagcgctgtcaatggacttgattttaatgggttggtgatatatggggtagacagttctataagtgaacatgaagcagatgaagaaatacatggacttatagaaacaaatgaactttggcatgagaatgattggaaaaaaaagtatcttttctttggagattcagatgtctcattgtactgtctagacactgcccaagggaaatatttagaattagataagccttcaggaaccacaatgagcgaatacgaaaatttcaattcaatgttagaagaagcgttaagaacaagtctttcctgagcaattggcgccttttctctttttgtggtatatggattgtggggaaattctttagactatcaacatagttggccaagacacactacccgtaaatgcggaggttaattatgcagaatattcactggagaaagcgcagtacgtttaaagaggcaactcatgagcaaattcatagtcttgaagaaactcttaacattaaatttccattagattataaagaatacataaaagaatccaatggatgctctccagtagataaacgtgttgttgttattgcgggatttagagaatcgattaataacctgctaagcattagagacccagagaggccaattgatctttataaaacattcaataatgttaaggatagattagttgacaacattattccctttgcaactgatgcaggaggcaacttattttgctttgattatagaaattctgaaacaagcccaactgtggttttttgggatcacgaagaagcatttgagaatccagaagcagcggtaacctatgtctgtgataatttcactgaattaattaacagtctaagagagtatgaagaagaataaagggaagtttttttatgatgaatttaaatttttagaccatctttacgttggtatagccttctctggatagtagaaataattattaagcacttaactttggttgagtgctttttttatgttcaaagccgagaaaaatccgacaaaaagggggataaaatgggggactttttctactccactttgtcatacgatagagacaagaaaaacgaacgtgaatatcgagtccaagaaggagagcctgcggacactgatcatttgcacacggatgttgtgcagctgattggtggccgcttttttattggccagaatgggagacgcacctttcccttatcaagtgtgtacccggatgtatcgaatgatgatgaaggtcgtcagcttcacaggaggagcggctggagtctatgcaggattgcgcgcgatagtcgcggggaacgcaagcggtgagatcccgtttgcacaggaagtcatttttatatggctccctataatctttgcgtcctcatggaagaaaatccaaagactctcctggtttcagttgtaaattttgatgaggctgaggaaaaagcgctcaacctggctttaaataagatcagcggtgactgggatgattacaaacttgaacaggttttgatctatcccttacaggcttctcagaaagtgaaatagatgaaatcttgggagagctggctgagcatgaaggcaacggaggaaaaatcaatgacagccaggaattagacctggatgattatgaagatgaccatttccaacatacctgcccaaaatgcggattttcatttaatgaataggtgattacatggaaaagaaagaataccgttggaagttggccgatttaaaaaacatcaagaaaaatggccttaaagtattcagcacattttcttgcggcgggggttcctctatgggctataagctcgctggctacgatcttttggggaaatgtgagatcgatccgcaaatgatgaagatttacaggaagaatcataacccgaaatatccttttcttatggacatcagagactttaacaaaatggaaaatctgcctgatgaattgttcgatttagatatttttgatggttccccgccctgcagcgtgttttctattgcgggggatcgggaaaaggcttggggaaaagaaaaagcctttcgtgaaggacaggcaaaacagtcacttgatgatctattttttcattaccttgatgctgttgaaaggctgcggccaaaaatctttgtggccgagaatgtcaaaggaatggtcagtggaaatgcaaaaggttatgtgaagctggtgattgaacgagccaaggaaattggatatgatgttcaactgttcttgttgaatgctgccacaatgggagtcccgcaacgtagagagcgggtcttttttattggccgaaggaaggacttgaatttactaccgtttaaattgtccttcaatgagccaccgattgtatataaagaattcagaagcggccatggtgcaaggcttaaagaaatatcaaagctttataaaagatgggtgaagcgacggccgtcggataataatgggagacatcacgaaaaggattgaagggaaagaatctaatttcaatacgatattagtgaaaaatagccttgtcccgcctactctcgggagtggttcggtatttgtccgttatgatgagccctactatatctctgaacgggatatcattttaatgcaatctttcccactcgattatgattttatggacgcatctgttcaatatgtttgtgggatgagtgttcctccggtcatgatgaaaaaaatatcggaacagatttacaatcagtggttttaataattctcactacatttagaaaaatgttattatttttctaaaaagggtggaatatatgaccgttgtgccggagaaattgtactgtagagcttgtaagagaaaaacaaaccatcagatagttaaaaatgagcatgacaatgaactaaagtattcaataagtaatttagattatgatgaagaaattgattttcaatttaatgaggattatgcaatagttcaatgtagaggttgtgacgctattgcttttctaaaaatatacggcgatgaagatatgtttcatatagtcggttcaaattatcatactgatagagaatactttgtcgaatacactgtctttccagaagagccaaaaaaggaggatccggtagaacagttattacaattcaaagaaaaatatgaattcgatcacttacctaacttaataaatggaattagaaatgaaacaattaatgcttatcgccaacgtatgaatttattatgcaatacgggaattagaatgcttattgaatcaatatgtatggtaaatggaattgataaaagaccgaagattaagaagggagaaccagtgttagatggtgataaaaacccggtaatggtcaatttaaatttggttcaaaagataaatgaacttaaagaaaagaatataattgatgaggaacaacgaaggatactcttggaaattaaagatgtaggaaatcagacagtacatgaaatatttcgaccgaaacggagagatttattgttatatctagaaacattagatttaatactatttaatatttatgaattacctcatattaaaataacaaattcaccaagccctagttagggcttatttttataaagagggtgctgacaacaccctcccttacccaaggccatcaccctggtaagagcgtgatgaagacgcggccgcgtttcgtgggaaaatcacgctctcatctctattctattggaggaccaggcaaatggcaatataaaatacaaacatacgttcctgcgatgataaagaaaaagagaaactgcttctcctgcatagcgctgaattgcttgaaaacatcagtcaatctaaagagaaatatcgaaaaattattcaggcaggtatcacccaatgggtcaaagattttcaaagcggccatattaaggtgaacactgttgaagatttaaaaaagctcatcgagctcgatatacagctgcagaaagatgaagaaatttaaaaacaaactcaaactcaattcaggttgcggaggtgggtgaaatgtaatggcgagaccgcgtgatccaagacgtgacgaagcgttccgtttatggaaagaaagcagcggaaccaagaaattaaaagacatcgcagatgaattgggcgtctcaagcagtaccgtccgcaagtggaaagcaatagataaatgggaagataaaatcaaagggagcgctcctaaatcgaatgggagcgctccttttcgtcccggtgctccaataggcaataaaaacgccaaaggaaacaagggcgggaatgcaccgcctggaaacgaaaatgcgaaagggaatgccgcaccaaaaggaaataaaaattccgcccgtaccggcgaatatgaaacgatcatgtgggattttttaaacgaggatgagagacagctgttcggagaaatcgaaacggacccactctttcaaattgacttaacgatcagggaattgagccttcgggagcggagaatgatgcagcggatcagtcggatagaaaacggcctatctgaaaaacagcgccgcgtgctgcaacaaatgcgcaaggtcaaggacatcgttcaaaccccggataagaatggactagtcaaacccgtcccggttatgaatgagcgtcttgttgtgactgaaattgaagaaaccgagatgcgggctattgatgatattttgaatatcgaggaggcactcacccgggtaacggataagcgattgaaggtcattcgccagaaatacgatatgatccgcttaatggatgagcaggaactgaagcttcgaggcatctatctttccaatgagacaaaacaggcagagcttgaacgccttaccgcccgccctgtggacaattctgtgaatatcacaattactcgtaagggtgacggcaaatgacggtaaaagaagtcaatccgcattttgaagattttctctttgactggaaccaaaaatttcagctgctcgttggcggttacggatcatccaaaagctatcacattgctctcaagctcattttgaagcttcttgaagaaaaacggacagtcttagtcattcgtgaagtgtacgacactcatcgggattctacattctctctttttgaagggatcatcaatgacttagagattgatcatattgtgaggtgtatgacatctccgatgcaagtcaggttcccaaatggcagccggatcatcttcaaggggctggacaaaccggccaaactgaaatcgatcaacaacatctcaataatatggattgaggaatgttcagaggtcaaatatgaaggctttaaagagcttctcggccgtctgcggcatcctacgctgccgcttcatatgattttttccacgaacccggtcggggaagacaactggacgtataagcatttctttaaagacgatctgaataatcgatttgtcctggatgataaagagctttatgaaaagcgaacgatcgttttaaatgacacatactatcatcattccacggcggaagataatttgtttctgccagaaagctatgtaaggcagctggatgaactgaaagaatacgatccagacctttaccgcatcgccaggaaaggtcattttggcgtgaatggggttcgggtttttcctcagcttgaagagtggccacacgatgaagtaatgcaggccgtctcgaacattgactgccccatcaagcgggtaggaatggactttggttttgaagaatcctataacgccgttgtccggcttgcggtggatcataagaaaaagtacctctatatctattgggagtattacaaaagaggaatgacggatgacaggacagcagaggagctccaagaatttaagaacacccaagagcttatcaaagctgattcagcggagcctaaaacgattcagtatttccgacagcatggtttcaatatggtgggagctcataagtaccagggttcgcgcctgcagtatacgaaaaagatcaagcggtttaaaaagatcatttgttccgaccaatgcaagaacaccatttttgaactcaagccgctgacctataaaaaggacaagctgggtaacatcattgaagatgaattcaagatcgatccccacactctttcggccatctggtatgccctcgatgattacgaggtcaccgatctgaaggagaaaccgaaaatccggcagcggccaaatagagagaggaggtaaagcatggctcaacaatctgtgaaagccaccgtgttcaaggcaaatgccccaagtgaaacgaccaaacagatttacgaagatcaattcgactataaaggaaatgacatcatcgagccgccttatagtttgaaggaattgaaaagcaccgcagagtattcaacgatcctgcagcagtgcatccatgcctataagaccaaatattctcggttttggttttgatgtagagtacacctttgatattaacggagatgatgtaaaacctggattttgcttttggcaacaggggaacgaatgtccactttttaaacttacgaattaattggaaaattgggagcgagcggggagcggattcgctcccaatcaggtatttttcgttcctccagaaaacaaaaaagagcaaagaaccttgatatcatgggctttcggttaagtggtgtcacatgctgtccataagggtcatcggccttctaagccatcggtctggagttcgaatctcccctgggacgtcactgaaaaaagcctcaaacttcttggcatacaagggtttgaggcttttggtgttgcaaaacaacaacatcctaaaaattccctttcatcatttcaaacaaaatgaaaaagctaaagggtgtgatcaattttaaggaggatgttgtaatgacaaaacaacagcaaaatcagcagcaaaagcagaagcaacaaaaacaaaagcatgagcagctgctcggggccaacatcacagataccgaacttgctcaggaattcggaaatatccagcagcagcttgcccagctggagcaaactgttaatcaaatggggtcacagcagcagggccaaagcggccagcagagctctcaattgagccagggaatcaatcagctgaaacagcaaattcagcagttcagctcccaatctcagcagcaaatgcagcagacggatcagcaaattcagcaaagcattcagcaggctgtccagcagctgaatcaggctcttcaagggatccagacaaaccaggccatgaaccaaatgagccaggcgcttcagcaggcgcagcagtcatttaaccagcaagggcagcaaggacaacagggtcagcaaaatcaacaaaaccagcagcaaaatcaaaattttcaacagcctctacaataaaaagctgtaaagagccgtttagcacggctcttttttatatcggtcattcctcgttttgatcctcttcgtcatgggttggatgcgctccgggatattgacgcggcgttccttgatgaagattgcggaattcgtatgcgaaattgctgtagtattgctggccttccttccatggcgtgcttttgttctcaacgggctcgtctttgccctgtgcagctccatacgcaccttcaggaaattcttcagctgttaaaaagtttctttgcgtttcaacgttcgaaatttcttttttgtcgtccatcagatcacccctgttttagttttattgttgccatgaaaaaggggagctatgtgttttcgttttgtatgcagtaggtttcattttaaaaacgggataagatgctcattctctgccgggagtacaaggggggaaatgcgccgatcacaaagaaaatagacattttgtacagaaagaacctgtcagataaagtggtattttatggtttattggtccttttctcctcagcttttaagagctgtccttctatcttatgacccgtctattctcgctttttgttatacatctcaattcagcaatggttttatctgttttccagattgatgtaaatggggcattggttgtaaaatttaccatgagagaaaatcttacaatgttcgttctgcttttattttagaaagggagctgaaaaaaggtgcatacgctagaaaaaatggagcaaacaaatttccagacggcgagagattatgtgacacaagcatacgagacagtacagaagcgaaatttttacgaaagcgaatttcttcaagctgtaaaggaaatatttgattcccttgtccctgtattggcaaggcatccaaagtatatcgaacaccgcattcttgagaggatcgcagagccggaacggatgatcaccttcagggtgccgtgggtcgatgatgaaggcaatatccgggttaaccgagggttccgggttcaatttaacagtgcaatcggtccgtataaaggcggcatccgctttcacccttctgtgaacgcgagcattattaaatttttgggttttgagcagatttttaaaaattctttgaccggactgccgatcggaggcggaaaaggcggggctgattttgatccgaagggcaaatcggacagggagattatgagttttacgcagagcttcatgaatgaactgtacagacatatcggaccggacacggatatccctgccggcgatattggtgtcggagcaagggaagtcgggtttatgttcggacagtataaaaagattcggggccgctatgatgcaggcgtgttaacaggcaaaggccttgaatacgggggcagtttaacgaggaaagaagcgacagggtacggtctggtttatttcgtggaagaaatgctgaaggatcaggggctgcgctttgaaaacagcaccgttgtcgtctccggttcagggaatgtggcgctgtacgcgatggaaaaagccgctcaattcggtgcgaaagtggtggcctgcagcgattctgacggctatgtctatgacgaaaaaggcatctgtcttgagacggtgaagcggctcaaagaagacgggaacggaaggattcgcgagtatgtcagcgagcatccggaagcacactatttcgagggatgtaccggcatttggtctattccatgcgatatcgcgcttccgtgcgcgacccagaacgaaattgacgaagaggcggccgaagtgctcatttcaaatggggtcaaagctgtcggagaaggagcaaatatgccgtctgaagagggcgccgtcaaacgctttttggatgcgggagttctattcggaccggctaaggctgcaaatgccggcggtgtagccgtttcagcgctcgaaatggcgcagaacagcgcacggcttcactggacggcggaagaaacggatgcgaagctcagggcgatcatggctgatatttacaagagaagcgttgaagcggcttcagaatacggacggcccggaaatctgctcgacggctgcaatatagccggatttatcaaagtggcggatgcgatgatcgctcagggagtcgtttaacggtaaaaagagagagcatgatgccctctctttttttgtgctttattcattgtctctgaatccaccggtaaaggcgtgtacagccggaacggaaattcccgggtagccgatgccgaatccgagcgtcggagtggtgaacaccccgccgtacggataataggtatatggcccgtgtgctgaaggattatagacataagtaaccgggtagccgaagtatcccgggtattggcgcacgcggggaacagagtgcgcaggaaatgtgcggtacatcatattcacctgtttctttttgattaacaccagtttatgtaaaaaatcgtaaaatggagtctgtacatatatgtggcaaaaaatctaaccggcggggatgaaattataaaaaattgtcgggataaaatctaacaaaactgtataaaacgccagtttttttatgtaatctttatagattacataaaaaattttaaattgtttttcaattttacatttccttttatatcaatcatgtaagcgtatacaaatagattgattaatcaaaattgtctaataattttaaaaaatacggttgacactgtatgtaaaggggcgtaatatgagttcaaacaaaagaacaaatcacttgaaaacttttcatctttcccgggaatgacagcgggaaaacgggttcccgcatcatgaatttttaatcgtttaaagcgttcatttacaacagaaaggtgtgcttgagggatgggggaccagaaagaccagtggatcttcctaaacgacaaactcgttaaaaaagaagacgctaaaatatcagtctatgatcacggatttttatacggggacggcgtgtttgaagggatcagggtatacgacggcaacatcttcagaatgcaagagcacatggaccgcctctacgattctgcgagatcgatcatgctggagattccatatccacaggaagaactgacacagcacgtactcaaaacagtcgaaaaaaacgggctgaaagacgcttacatccgcttggtcgtttcaagaggagcaggtgacctcggactcgatccaaacaattgttcaaacccgagtgtcatcataattgtcgaaccattggcaatattcccgaaacatttatatgaaacggggattgacattgttacggttccgacaagaaggaacagacccgatgtgctgagccctaaagtaaaatcgctgaactacttaaacaatattcttgtccggatcgaggcgcatatggcgggtgtgacggaagcgctcatgctcaatgatcaaggctatgtcgccgaagggtctgcggataacgtatttatttataaaaacggaaagctcttgacgcctccgggctatatcggagcgcttgaaggaatcacccggaatgccatcatcgaaatagcgcgagagctcggctatgaagtgaaagaagagccgtttacccgccatgacgtatacacagccgaggaagtgtttttaaccggaacggctgcagaagtcatcgcggtcgtaaaagttgacggccgcaagatcggggacggcaaaccgggagtccacacaaaccggatgcttgaaaagttccgcgagcgcgtcgtccgtgaagggttaaaagtcagcctcaaagatcaaagcttaagtgtcagctgaataaagataaacgttgaagaggataagtagcagcggaaacgccgcctgcagagagccgggattgctgggaaccggtgacggcctccgcttgtgaactcccctctgagtgtcagtctgaacgatttccatgtttagtagggctggccgggtgaacattacgaaggttcactcgttattaaaccggataagcgattatccataaggcggctttcaaaagccgcgaacaagggtggtaccgcggaaagaaaagccttttcgcccctttggcctgcaaggtgtgcagcgtcaacagtgggcgggaaggctttttttagctgcaaaagcagattggatacatgctttgcggcacatatatattgattattttttgaaaaacaattgtgaatgaacagtgatgatgatcacttgataaggaggaagaaaaatggggacgaatgtacagttggatgctgaaaatgcccaatgtacacaaacaatggcaggggcgtcaatgctgatcgaggctttaaaacaggaaaatgttgaagtgatctacgggtatccgggcggtgcggtcctgccgatttatgacaaactctacggatcgggaatgtttcatgtgctgacgcgccatgaacaaggcgccatccacgcagccgaaggatatgcaaggatttccgggaaaccgggtgtcgtcatcgctacatccggaccgggagcgaccaaccttgtaacgggtctggccgacgcgatgatcgattcattgcctctcgtcgtattcaccggtcaggttgcgacatcggttatcggatctgacgcattccaagaagcggacgtcatcggaattacgatgccgattacaaagcacagctaccaggtacgcaatgccgaagatttgccgagaattattaaagaagcattccatatcgcaacaacaggaagaccgggccccgttttaatcgatattcctaaagacatcgccgttgtagaaggagaattccgctatgaccacgacattcaccttccgggctatcagccgacgaaggaaccgaattatctgcagatcagaaagcttgtggaagcggtcagtgcagcgaaaaagccggttattttagcgggtgcgggcgtcttgcacgggaaagcgtcagaagaattaaaaaattatgtcgaacagcagcagattccggtggcacatacgctgttaggcttgggaggatttccggccgatcatccgcttttcctcgggatggccggaatgcacggaacgtatgcggccaacatggctctgtatgaaagcgatctgttaatcagcatcggtgccaggtttgatgaccgggtcacagggaacttgaagcattttgcaaaatatgcgaaagtcgctcacattgacatcgatccggctgaaatcggcaaaaacgttcatacgcacattccggttgtcggcgacagcaagcttgtactgacggagctgatcaagcaaaacggcaagccgagcgcttctgatgagtggaaaaagcagcttgcggcatggaaaaccgaatatccgctctggtatgaagaaaatgaaacagaaggattcaaaccgcagaagctgatcgaatatatccaccgctatacaaagggcgaagctattgtaacaacagacgtcggacagcatcaaatgtgggccgcgcaattttatcagttccaaaaagccgacagatgggtcacttccggcgggctcggcacaatgggcttcggacttccggcggcaatcggagcacagcttgcggataaggatgcgacggttgtatcgatactcggcgacggaggattccagatgacgctgcaggagctgtctgttattcacgatctgaaccttccgatcaaggtcgtggtcttaaacaaccgctgcctcggaatggtccggcaatggcaggaaatcttttacgatgagcgctattcgcactccaagttcacatcacagcctgatttcatcaagctgtctgaagcttacggcatcaaaggcgtccgaatcacatccgaagaagaagcggaagaaaagctggaagcggcgctaacgtcgaatgaaccgatggtcattgatgttcaagttgcacaagctgaaaaagtatttccaatggttgcgcctggaaaagggctgcacgaaatggtgggggtgaaaccttgaaaagaatcatcacgctgacggttttgaaccaaagcggcgtcttaaacagaatcacagggttgtttacaaaacggcattacaacattgaaagcattacggtcggccacaccgaaaccgcgggaatttccagaatcacgtttgtcgttcatgtggcagatgaaaaagaaacggaacagctgacaaaacaattaaacaagcagattgatgtactgaaagtcacggacattacgaatcaatcgatcgtccaaagagagctggcgttaatcagggtggtttcccctccgtcgagcaggacggaaataaacggcgtcatcgaaccgtttcgggcgtctgtcgtcgatgtcgcaaaagacagcgtcgtgattcaagtgacaggggaatcgagcaagatcgaagccctgatcgaactattgaaaccatacgggattaaagaggtagccagaacaggcaccacggcctttgcgaggggaactcagcaaaagccggcctctattaaaacaatatctattgtataaatcataaaaagggagagattgaaatggtaaaagtatattataacggtgatatcaaagaaaacgtattagcaggcaaaaaagtagcggtgatcggatacggctcacaaggccatgcgcacgcactgaacctgaaagaaagcggagtggacgtcattgtcggcgtcagaaaagggaaatcctttgcaaaagcagaggaagacggccatcaagttttcacggtaagagaagcggcagaacaggccgacatcgtcatggtgcttcttccggatgaacagcagcaaaaagtgtatgaagcggaaattaaagacggacttcaagctggcaattcacttgtattcgcccacggattcaacgttcatttccatcagatcgtgcctccggcggatgttgacgtattccttgtcgctcctaaaggaccgggacatcttgtcagaagaacgtttgaacaaggtgcgggggttccggcgctgtttgcgatctatcaggatgtgacaggggaagcgaaagacaaagcccttgcttatgctaaagcgatcggcggcgcaagagccggtgttcttgaaacaacatttaaagaagaaactgaaaccgatcttttcggagaacaggcggtgctgtgcggaggattgacttcccttgtcaaagccgggttcgaaacgctgacagaagcgggctatcagcctgaactcgcatacttcgagtgtctgcacgagctgaagctcatcgtcgacttgatgtatgaagaaggtttggcagggatgagatattcgatttccgacacagcgcagtggggagacttcgtatcaggtccgcgcgttgtcgatgagaaggtaaaagaatcaatgaaagaagtattgaaagacatccaaaacggtacattcgcaaaagagtggatcgtcgaaaaccaagtcaaccgtccgcgtttcaacgccatcaatgcaagcgaaaacgaacaccaaatcgaagtggtcggcagaaagcttcgcgaaatgatgccgtttgtcaagcagggcaagaaaaaggaagcggtggtagccggtgcgaaaaattaacttttttgatacgacactccgtgacggtgaacagtcgccgggcgttaatttaaacacgcaggagaagctggcgatcgcccagcagcttgaaaaactcggggtcaacattatggaagcgggctttcccgcttcatcccccggggatttcaatgcagtaaaagaaatcgcaaggacgattaaaaactgttcggtaacagggcttgcccgctctgtcaaaggagatatcgactcggcgtgggaagcgctcaaagacggagctgaaccaaggcttcacatttttatcgccacttctgacatccacttaaaatataagctgaaaaaaacgcgcgaacaggttctggaacaggcggtcgcaatggtgaaatacgccaaagaacgcttcccgatcgtccagtggtctgccgaagatgcgtgccggactgatcttccgtttttagccgagattgtaagcgaagtgatcgccgcgggagcggatgtcgtcaatctgccggatacggtcggttatttagcgcctgccgagtatggaaatatcttccgctatattaaagaaaatgcccgcaatgccgacaaagtccagctttcagcccattgccacgatgacttgggcatggctgtcgccaactctttggctgcgattgaaaacggagcggatcaagtcgaatcggtcatcaacggcataggcgaaagagcggggaacgcctcgcttgaagaaatcgccgtcgccctccatatccgaaaagatttctaccaggcggaatcaacgattcagctgaatgagattaaacggacaagtgatttagtgagcaagctgaccggcatggccgtgccgcggaacaaagcggttgtcggcgataatgcctttgcccacgaatcaggcattcaccaggacggcttcttaaaagaaaaaacaacatatgaaattatttctccggaacttgtcggcgtgaaaacggatgcgcttgtgctcggaaagcattcagggcgccacgcatttaaagataagctgcaaaacctcggattccagcttggagaagaagaaatcaataaattcttcaacatttttaaagagcttaccggaaagaaaaaggaatttacggatgaagatctcatctcgctgatactcgaagagaaaacggcagaccgcaaaatcggctatgattttatttcactgcaggttcattacggcacctcccaggttccgacagcaacagtctcccttaaagatcaggaaacggatcaggtcatccaggaagcggcgaccggagcgggaagcgttgaagcggtgtacaacacgctgaagcgctgtatggataaagaagtccagctccttgattaccggattcaatccaaccgcaagggacaggatgcattcgcgcaagtatacgtcagggtgatgatcgatggaaaagaatcgggaggacgcggggttgcccaggatgttctcgaagcatctgccaaagcctacttgaatgctgtgaaccgctatctcgtattgaagacgaatacggaaggattgtcaaaacaggcggctgtaggatcataacagtaagaaggaaggagtttgttgaatttgaaaaaacgaatcgcacttttgcccggtgacggaattggtcccgaagtattggacgcggctgttgatgtgctgaaaagcgttgctgaacattatcagcatgaattcgaatttgaatacggcctgatcggcggggcggcaattgatgaggcaggagcgccgcttcctgaggaaactgtcgccgcctgcaaagctgcggacgccattttgctcggagctgtaggcgggccgaaatgggatcaaaatccttctgagctgcggcctgaaaaagggctgctcgccatccgcaagcagctcgatctttttgccaatctgcggcctgttaaagtatttgaaagccttgcgggagcttctccgttaaaaaccgaatatatcgaaggtgttgactttgtcatcgttcgcgagctgacgggcggcttgtattttggaaagccgagcgagcagtacgtcaatcagaacggcgaggaagaagcggttgacacgctgttttataaaaagtcggaaatggaaagggtcatcagggaagccttccaaatggcgcagagtcgaaaaggcaaagtgacctccgttgataaagccaacgttcttgagtcaagcaaactatggcgcaagacggcggaagaagtggcgaaagagtttcctgacgtcaagcttgagcacatgctcgtcgacaatgcagccatgcagctcatctatgcgcctggacagtttgatattatcgtgacagaaaacatgttcggcgatattttaagcgatgaagcatcgatgctgaccggatcgctcggcatgctgccgtcggccagcttatcaagctctggacttcatttatacgaacctgtgcacggctcggctcctgatatcgcgggacagaacattgccaatccgcttgcggcgatcttgtccgcggctatgatgctcaggacgtcattcggtcttgaagctgaagcgcaagctgttgaacatgcagtcgatcaagttctccgggcaggaaaacggacgaaggacctggcaaaaggctcggaacattgcacaactcaatcgattacaggggaagtaaaagccgcgctggcagacgacaatgccatttcaaacatcatgaccgcttacgtttaaggaaaatggatattggtagagggaggaagaaagatgatgcctcgaacgatcatcgaaaaaatttgggatcaacacgtgattaaaaaaggtgaagggaagcctgaccttctctatatcgatctgcatctgatacatgaggtaacgtcgcctcaggcctttgaaggcctgaggcaaaagaacagaaaagtcagacggcctcaaaatacgtttgccacgatggaccacaacattccgactgtcaatcggtttgagattaaagatgatgtcgctaaacggcaggtcagtgcgctcgaacggaattgcgaagaattcggcatccgccttgcagacttgtcaagcgtagaccaggggatcgtccatgtcatcgggcctgaactgggattgacgctcccgggcaaaacgatcgtttgcggagacagccatacatccacacacggagcgtttggcgcgctcgctttcggaatcggaacgagcgaagtcgaacacgtcttgtcaacgcagacgctttggcagcaaaaaccgaagacgctggaaatccgcgttgacggcaaactgcaaaaaggagtgacggctaaagacgtcattctggcgatcatcggaaaatacggggttaaattcggtgcgggctatgtcattgaatataccggcgaagtgttccgagacatgtcgatggacgaacggatgacggtttgcaacatgtcaatcgaagctggggcaagagctggattgattgcaccggatgagacgacgtttgaatatgtcaaaacaaaaaaatatgcgccaaaaggcgaggattttgagaaagctgtagaagaatggaagaacctgaaaaccgatccgggggcggtctacgaccggacgatcgtgatggacggaagcgccatttctccgatggtgacgtggggcatcaaccctggcatggtgctgccggttgatgaaacgattccggggcctgaggctttcttgcaggaagacgataaaaaagaagcgcagcgcgcatatgaatatatgggtcttgaaccatataaaaaaatcgaggacattacaattgagcatgtctttatcggttcatgcaccaactcgcgtatgacagatcttcgccaggcggccgaaatgattaaaggtcaaaaagtcgccgacggcgtcagagcgatcgtcgtacccggctcgcaaagcgtcaaaatccaagcggaaaaagaagggcttcacaagattttcatcgaagcgggctttgaatggagagaatcgggatgcagcatgtgtttgagcatgaacaatgatgttgtccctgaaggagagcgctgcgcttcgacttccaaccgcaattttgaaggcaggcagggcaaaggagccagaacgcatctcgtcagcccggcgatggctgcgatggccgcgattcacggccgctttgtcgatgtcagaaaatattaccaagagacaacagctgtatagaggagtgacaagatggagccattaaagacccataacggaatagcggcggtgctaaacagaatcaacgtagacacggaccagatcattccgaagcaatttttaaaaaggatcgaaagaacgggatacggccgttttgctttctttgactggcgctatctggataacggcgatcccaatcctgattttgaactgaaccggccggaatacaaaggcgcttcgattttaatcgccggcgaaaacttcggctgcggctcttcaagggaacacgcgccatgggcgcttgacgactacggatttaaaatcattatcgcgccgtcttttgccgatatctttcaccaaaactgttttaaaaacggcatgctgccgatccgccttccttatgaggcgtggaaagagcttgctgaacagtatgagtatcaatctttgacgatgacggtcgatctcgaaaaacagacgataacagatcatgccgggcggcagattgcctttgaggtcgatccgcattggaaagagatgctgctgaacggttacgacgaaatttctttaacattgctccttgaagaagaaatcgaacaatttgagaaacagagaagttcttggctgcaagcataaaaaagctgtccgatgtagatcggaggctttttttgctggcggcagcatactgccgccggttctttcttgtgtttagcgggccgggttgatacacttgttaaaaaataagtgcctgaaaggaacttagaaatgaagcatgacaagaagaactcgaagatcataccgttcccgaacgtaaaggagcgtttagtgcacaaagggatgggtgcgctcaaagaaaagaattaccatgaagcgctcaggctgttttctgaagcgaagcgctatgatgatgaggaatctgatatttatctgggaatggccatctgcctgcttgaaatcggcgagcttgaagaagcgaaaggcatctgcgaaaaaatgctgaaggaaggccacggccactattttaccgttttgcaagtctatatgacgattttaatccagctcagacaatacgaaaaagttaaagaaacgatcgaagctgtactcgaagaaaacaagcttcctcctgaaagcgcggaacagttttataaactgcttgatttcagccgcaagatgacggaagacccggggcctgaggacatcaccgaagaccttcccgagacggaggaggttgatcaggaaaggcttttgaatgacacggaagagcaggttaagcttcttcacgggctgaaggaccgcaatctgacaagctatatcggcttgttgaaaacgattctgcaaaatccgagcgcacatcctgtcgtaaaaacgatgattcttcagcttttagccgagtcagaccatgaaaagccgacgcttgtcgcaaaatttggcgattcgatgacaattaatccgacagagacggtcaagcctgatgacatgccgatattaaagcatgttctgagcgtgctcgatgatacgctggggaatgaaaatcccacgctgtaccaggcggtcgaagagctgtggagaaggcatatttacgtcctctatccgtttcagccgaaatactcaaaccgcgagctctgggctgctgcactgcataaagtcggatatgagatgcacgggatcgacatcgataaagaggagcttcatattctctatgaattcaatgacagacagcttgacgaagcctgcgcgctgatcaaagacatagaagaaatttcttatttgtaaatgttgaaagcagcaggcattgtgttataatatagtggttgcatttgtgaaaaacggaagttgatccgtttgccgctaaagattcattatttatctttgtatacataatgatggctgtcagaaacacatgagctgcactcagtcggcagcttgcgatggacgtagccgtttgcttgttttaaaatggaaaaccgacacaacctgaatagattttggagggaaacacatgtcagtaaaatgggaaaagcaagaaggaaacgaaggcgttttaacggttgaggtagatgccgatacctttaataaagcccttgatgatgcatttaaaaaagtagtaaagcaagtatccattcctggattccgcaaagggaaagtgccgcgcggtttgtttgaacagcgttttggcgtagaggcgctttatcaggatgcgctggacatcctgcttcctgtcgaatatccgaaagcggtagaggaagcaggcattgagcctgttgaccgtccggaaatcgatgtggaaaaaatcgaaaaaggcgaaaacctgatcttcactgcgaaggtaacggttaagcctgaagtgaaacttggcgaatacaaaggccttggcattgaaaaagacgatactgccgtaacggatgaggacgttcaaaacgaacttaagtctctccaagagcgccaggctgaactcgttgtaaaagaagacggcaaagttgaagaaggggacactgttgttcttgacttcgaaggattcgtagacggcgaagcattcgaaggcggaaaagcggaaaactattcccttgaagtcggttcaggctctttcatcccgggctttgaagatcagcttgtcggacttgaagccggtgctgaaaaagacgttgaagtgacattcccagaggaataccacgcggaagagcttgcgggcaaacctgcggtattcaaagtgaaaattcacgaaatcaaagcgaaggagcttcctgagcttgatgacgagtttgcaaaagatgtcgacgaggaagttgaaacgcttgccgagctgactgaaaaaacgaaaaaacgtctcgaagaagcaaaggaaaacgaagcggacgctaaacttcgcgaagagcttgtcttgaaagcagctgaaaacgctgaggctgacattcctcaagcgatgatcgacacagagcttgaccgcatgatgaaagaattcgaacagcgtcttcaaatgcagggcatgaaccttgagctttacttccaattctcaggacaggatgaaaacgcgctgaaagagcaaatgaaagaggatgctgaaaaacgcgtgaaatccaacctgacactggaagcgatcgccaaagcggaaaaccttcaagtcactgacgaagaagtcgaagaagagctttctaaaatggctgaagcatacaacatgcctgttgaaaacatcaaacaagcaatcggttctacagacggaatgaaagaggacttaaaagttcgcaaagcaattgattttcttgtagaaaaccgttaatatgtttcataatcatactttatataaaacagggcgcgaatgtttcgtgccttgttttatacaattttgacttatcatcttttctttgggaaaggatagataatgtcgttttgatcaacatacatattgaatatgccggacggcaaacacaacgttatcgcctttttggaaagtgtggtaaaatgcaatacataatggaacgaatgttttcaagcgatgtttcttttaacgaagaaacaggaatgacaaggatataaggggtgaaagaatgtttaaattcaacgaggaaaaaggacaattgaaatgctcgttttgcggtaaaacacaagatcaggtacgcaagcttgtcgccggaccaggcgtatatatatgtgacgagtgcatcgaactttgcactgaaattgtagaagaggaactcggctctgaagaagaagtggagttcaaagatgttccgaagccaaaggaaatccgcgagattcttgatgaatacgtcatcggccaggaccaggcaaaaaaatcccttgccgtggccgtctacaatcattacaagcggatcaattcgaacagcaaagtcgacgacgtcgagctgtcaaaaagtaacatttccatgatcggaccgactggaagcggaaaaacgcttcttgctcaaacgcttgcccgcatcctgaatgtgccgttcgccattgcggatgccacgtcgcttactgaagcaggctatgtcggtgaagatgtggagaacattttgcttaagctgatccaggcagctgactacgatgttgaaaaagcggaaaaaggcattatctacatcgatgaaatcgataaagtggccagaaagtccgagaacccttcgattacacgcgatgtatcaggcgaaggcgttcagcaggcattgcttaaaattcttgaaggtacggttgccagcgttcctccacaaggcggaagaaagcatcctcatcaagagttcatccaaattgacacaaccaacatcctgttcatttgcggcggagcttttgacggaatcgagcagatcatcaagcgccgtctcggccagaaggtcatcggcttcggctctgacaacaagcatgaagaccttgaaaaagaagcgcttctttccaaagtgcttccggaagacttgcttcgcttcgggctgatccctgaattcatcggccgtctcccgatcatcgcaagccttgagccgctggatgaaaaagcgctggttgaaattttaacaaaaccgaaaaacgcgcttgttaaacaatatagaaaaatgcttgaattggatgatgtggagcttgtgtttgaagacgaagcgctcacagaaatcgctaaaaaagcaattgaacgtaaaacaggagcacgcggacttcgttccattatcgaaggaatcatgctcgacgtgatgtttgatctgccgtctcgcgaggatattgaaaaatgcgtgatcacaggcaaaaccgtcactgacggcgaaccgccgcgtctcattatgaaagacggcacggtcgtcaataaagacaaaaaaacttcagcataatgcagagaacctcctggcctaaaggaggttctttttttgcatccggaaaccgtcggcatcccggagcagagtgacggcttcaaaagcaaaataatccctttctgtacgtttattccctccctgatcaggaaatactatctgacatactaaagatacgaaaccatttcaggagggaccatcagttgagctggacgagcattgcactttttgtacaactatttttcgggatcatcatcggattatatttttggaatttgctcaaaaatcaaagaacccaaaaggttacgatagacagagagtccaaaaaagagatggaacagctccggaaaatgagatcaatccatttatcagaacctttatcggaaaaggtgaggccgacggcttttaaagacatcgtcggccaggaggacggcattaaagcgctgaaagccgccctttgcggaccgaatccgcagcatgtcattatttacggccctccaggtgtgggaaaaacggcagctgcaaggcttgtccttgaagaagcgaaaaagaacaagcgctcaccgttccaggaacattccgcctttgtcgagcttgacgcgacaacggcccgtttcgacgagcggggaatcgccgacccgttgatcggttcggtccacgatccgatttatcagggcgccggagcgatggggcaggccggaattccccagccaaagcagggagccgtcacgcatgcacacggtggagtattattcatcgatgaaatcggagagcttcatccgattcaaatgaataaaatgctgaaggtgctcgaagatcggaaagtttttttggaaagcgcctattacagtgaagaaaacacgcaaatccccaagcatattcacgacatttttcaaaacgggctgccggcggatttcagactgatcggcgcgacgacaaggatgcctgatgaaatcccgcctgccattcggtcgagatgtttggaagtgttcttccgcgaccttgaaaagcacgaattaaaaacggtcgccaaaaaagcggcagataagattcaaaagaaagtcgcagaggaaggactcgacctgttgacgcggtatgcgagaaacggccgcgaagtcgtcaatatgatgcaaatcgccgccggaatggctttgactgaagagcgcgacgaggtgacggttgaagatatcgaatgggtgatccattcgagccagctgacaccgaaatacgaacaaaaaatcgcctctaaaccgcaggtcggcatcgtcaacggacttgccgtccacgggcctaacagcggttcgctgctcgaaattgaggtcacagtcaatcaggcggctgataaaggatcgattaatatcacaggcattgcagaagaagagaatatcggcaaccagtcaaaatcgatccgccggaaaagcatggcgaaaggatcggtcgaaaacgtcatgactgtattgcggacaatgggagtcaaagcttcggattatgatattcacgtgaatttccccggcggtatcccggttgacggaccatctgcagggattgcaatggcggcgggcatattctccgctattcataagattccgatagaccatactgtcgccatgacgggtgaaatcagcctgaacggccgggtaaagccgatcggcggcgtgattccgaaaatcaaagcggccaagcatgcgggggcaaaaacagtcattattccgcacgaaaatgttcagtcgattttaaagcggatagaaggcatacatatcgttcccgtcaaaaccttgcaggaagtactcgacctcgtattggtcaaccctccttcagaaatgctcgacggcgttcaaatgaaaagagaatccgtttaaatccccatcgtttcagatggggatttttttcggggcggtttctccgaagccgggagccggcatgttttcttagcggaggacatcttttcctttttcagaactgaaagaaagggtatactacaggagaccctttttatttcgccgggcttacaattgtacaggaataaaaaaagtatattataatggttcatactaaagttacggaggtgtcagtcaaaatggcagatgaaacgaaacgaaacatcccgctcctccctttaagaggtttactcgtctatccgacgatggttttgcaccttgacgtcgggcgtgaaaagtcggttcaggcacttgaacaggcgatgatgaatgaccatatgatctttttggcaacgcaaaaggacatatccatagacgaaccggatgaagacgagatttttacattcggaacctatacgaaaatcaagcagatgctcaagctgccgaacggaacaatccgcgttttggtggaggggttgcagcgcgcccgcattcttgagtaccatgacttagatgaatatacgtctgtaaaaatcgagcgaatcgatgaagagactgaaaaagatgttgaagatgaagcactcatgcgcacattgcttgaccacttcgatcaatacataaagatttcgaaaaaaatatcggcggaaacatttgccgctgtgacagatattgaagagccgggaagaatggccgatattgtcgcctcccacctcccgctcaagctgaaagacaagcaggaagtgctggaaacgatcgatgtcaaagccagattgaacaaagtaatcgacctgattcacaatgaaaaagaagtccttgagattgaaaagaagatcgggcagcgcgtcaagcgttcaatggaaagaacacaaaaggagtattacctgcgcgagcagatgaaagccatccaaaaagaacttggcgataaagaaggaaaaacgggcgaggtccaaaagctgaccgaaaaaatcgaacaggcaggaatgcctgacaatgtgaaagaaaccgcgcttaaagagctgaaccggtacgaaaaaattccgtccagctcagctgaaagctctgtcatccgcaattatatcgaatggcttatttctctcccatggaacgatgcaacagaagacaggctggatttaaagctcgccagtcaaattctcgatgaagaacaccacggccttgaaaaagtgaaggagcgggttctcgaatatttggctgtccagaagctgacccgctcgttaaaaggaccgatcttatgcttggccggccctccgggtgttggaaaaacctctctggcgaaatcgatcgccaaatcgctcggacgcaaattcgtccgcatttcccttggcggcgtgagggatgaatctgaaatccgcggtcaccgccgcacatatgtaggcgccatgccgggccgcatcattcaggggatgaaaaaagcaggcaagaacaatcccgtattccttttggacgagattgacaaaatggcgtcggatttcaggggagatcccgcttcagcgatgctggaagtgctcgatcctgaacaaaaccatacgttcagcgaccattatattgaagagacatttgacttatcaaaggttttgtttatcgcaaccgcgaacaacctggccacaatccccggcccgctcagagaccgcatggagatcatcacgatcgccggctatacggaagtggaaaaggtcgaaatcgtcaaagaccatctgcttccaaaacagctgaaagaacacggtttgaaaaaatccaatctgcaaatacgggagcaggctgtcctggccgtcattcgctattatacgagggaagccggcgtcagaaatcttgaacgccaaatcgcagcgatatgcagaaaagcggcgaagctgatcgtatcaggggaaagaaaaagaattacggtcacagacaaaaaccttgaagactatttaggaaaaagaatgttcaggtacggacaggctgagctcgacgatcagatcggcgttgtcacaggtcttgcctacacgacggtcggcggtgatacgctgtccatcgaagtgtctctttcccccgggaaaggcaagctcattttgaccggaaagctcggcgatgtcatgagagagtcggcgcaggccgcattcagctatgtccgttcaaaggcggaagagttgaacatcagccctgattttcacgaaaaacacgatattcacattcacgtgccggaaggagccgttccgaaggacggcccatccgcggggatcacaatggcgacggctcttgtctcggcgctgacgggccgacctgtttcgcgaaatgtcggcatgaccggcgaaatcacgttaagaggccgcgttcttccgatcggcggcttgaaggaaaaggcgctcggcgcacaccgtgccggcttaaagactgtcattatgccgaaagataatgaaaaagacattgaggacattccaaacagcgtgcgggaaggcttgaccttcattcccgtcgctcacctggacgaagttctaaagcatgcgctagtaggagaagagaaatgaaagtaacgaaatcagagattgtcatcagtgcggtgaaacccgagcagtaccctgaagggggactgccggaaatcgcccttgcagggagatctaatgtcggaaaatcgtcattcatcaatacaatgatcaaccgtaaaaacttagcgaggacatcttcaaaaccgggcaaaacacagacattaaacttttatatcattaacgatgtccttcactttgtcgatgtgcccggctacggatttgcaaaagtctccaaaacggagcgcgaggcttggggccgtatgatagagacgtatttgacatcccgcgaagaactgaaagcggtcgttcaaatcgtcgacctcaggcatgctccttcacaggatgatgtgatgatgtacgactttttaaagcattatgaaattcctgtgatcgtgattgcgacaaaagcggataaaatccctaaaggcaaatgggaaaagcatgccaaagtcgtcaaagagacgcttaatatagaaaaagaagaccggctcatattgttttcctccgaaacgaaaaagggtaaacaagaagcatggtcggcgatcgagcaaatgatcgcgagataaagaaaaagcacttgcgggattgatgcaagtgctttttcttgaataaactattttctttttaagaataataagagcagactaaccgcgataaaagcggccggccaataagcttctacatatgccgtctcgatattcaccgacttcagccaggcggcaatttgccggaaaaagtaaagatagagggcgaccgcgatcatcagcagactttcatattgatattcttttgtcttaaacgatttgacaagcagcgccgcaccgaagatcagcacgatgaccgcaaaatcatccgcgcggctgaaatagtcctctttaaatgtgaaataaacgccgatcgctgtcattaagagccctgcaaaggaatgggcggaatcggcttccttctgtccctgataaaaaagagccagtccgacgagacctgcaagtacagaccattcttcctggccgtcaaacaggctgatccggcccgaccgcaaaaaggcgtagacagcaacggctatcaacagcaatggaagcaaaacagatttctttttcaaagtatcaccttcttgatgtagtgaaagaaatagaaacacattttctactatatcacatcaattttttaaaatctgttcacattttgggaagagaaaatagtgaatatatgttataatcgttttgaataataaattctatattataatcattctaatttagatagatgttgggggtgcaagcaagagttatgcatatacttgtcgtgggattggattacaaatcagcccctgttgatatacgtgaaaagttaacctttcagccggatgagctggggcaggcgatgtcgcaattgaaagaagaaaaaagcatacttgagaacatcatcgtgtcgacatgcaaccggacagagctgtatgcagtcgttgatcagctgcacaccggacgttattatatgaaaatgtttttggcgaactggttcggattaagcaaagaggacgtttcgccttacttgaagttttatgaaaacgacggggccgttgaacacctgttccgcgtatcgtgcggattggattcgatggttattggagaaacgcagattttgggccaagtgcgtacaagttttaagctggctcaggaagagaagacaattggtaccgttttcaactatttgtttaagcaggcggtcacggtcgcaaagcgctgccatgccgaaacggacattgcttcaaatgctgtatccgtcagctatgccgccgtcgagcttgccaggaaaatcttcggcgacctttccgataaacacgtgctgattctcggggcgggcaaaatgggtgagcttgcggttcaaaacctgcacggccacggaatcggacaggttacggtgatcaacagaacattttcaaaagcgaaggagcttgccggccgtttttcaggcgcggcgaaaagcttgaatgagctgcaatgcgctttgatggaagccgatattctcatcagttcgaccggcgccagcggctatgtcgtcacaaaagagatgatcgaacatgtcaataagcttcgcaaaggctgtccgctttttatggtggacattgccgtgccgcgggatcttgacccggctctcagcgaagtggaaggcgtcttcctgtacgatattgacgatcttgaagggatcgtcgaagaaaatttgaaggaacgccaggccgttgccgaagaggtggagctgattattgaagctgagatcgtttcttttaaacaatggctgaatacgctcggcgtcgtgccggtcatctcggctctcagggaaaaagccttgacgatccaggcggaaacgatgcagagcatcgaacggaagctccctcatttgagcacaagggagaaaaaacttttaaacaagcatacgaaaagcattatcaaccagcttttgcgcgacccgattttaaaagtgaaggagtttgcgtcagaagctgatgccgaagaaaagcttgcactgttcacgcagatttttgatattgaagaagcggcttttcccgacggggagaagcaggacgaacgtcagccggttcatgcgtttaagcggcaaaatccgcagggtttgacttctatcgcgagcgagtgacagacatgacagacacattgttagcaaggcttaacgaagttacaatcgtgttgtacgcgttcaccgttctcttttattttatagactttttacagcacaaccggaaggcgggaaaagcggccttctggttgctttctattgtctggattctccagacggtttaccttttttatttcatgcagtacacagatcagtttcctgttttgaataatgcgcaggggctttatttttacgcgtgggtgctcgtgacgctgtctctcgttttgacgaaactcttgaaggtggattttctcgtttttttcaccaatctcatcggcttttcaatggcggcgatccacacgtttactccgacggcccagcagtcggcggagctttcgggcaggctcgtgtccgagcttttgatcatccacattacgatggcgattctttcgtacggggcattttcattgtcctttgtcttttccgtgctgtatctttttcagtaccgcttattgaaaaagaaaaagtgggggaaatggcttttgagaatagaagatttgtcaaaacttgatcatatggcgtatgtcctcaatctcatcggcgttcccatgcttctgctgagcctgattctggggattatctggtcgtatgtatcgcttgaaaccctgtactgggcggatccgaaagtgcttggatcgatcgtgctgctttttttatacggatactatttatttatcaggattgtcaaagagctgcagggaaggatcgcggccatgtggaatgccgcgtcttttcttgttcttttaatcaatttctttttgctcggcagcttttcgcagtttcattggtttagttagttaaaacggttgcccgtgacggattgggaggaagaaaacatgagaaacatcattgtaggctcaagaagaagcaaattggcgatgacccagacaaaatgggtgatcaaaaagctggaggaattaaatccggatttcacgtttgaaataaaagaaatcgttacaaaaggcgaccggattttggatgttacgctgtcaaaggtcggcgggaaaggcctgttcgtcaaagaaatcgaacaggcgatgctttccggggagattgacatggccgttcacagcatgaaggacatgccgtcggcgcttcctgaagggctgatggtcggctgcattccaaaacgggaagaccccagggacgttctcatttcaaaaggccgtcaaaagctggctgacttgaaacaaggcgcagttgtcggaacgagcagcctcagaagaagcgcacagcttttgcaaatgcgccccgaccttgagatcaagtggatcaggggaaatatcgatacaaggctgaaaaaacttgaaaccgaagattacgacgcgattattttagctgcggccggcctgtcaagaatggggtggaaggacgatgtcgtcactgaatttcttgatccggaaagctgccttcccgccgttgggcaaggcgctttggcgatcgagtgcagaggctctgatgaggagctgctgtctctcttttcgcgcctgaacgaccgctacacacagctgaccgtcacggctgagcgcgcttttcttcatgcgatggaaggcggctgccaagtgccgatcgcaggatttgcaaagatggacgaagacggcgtcatcgaactgaccggtcttgtggcatcgcctgacggaaaaaccgtatacagagaaacagtaaaaggaaaagatccggaggctgtcggcagagaatgcgccgcagtcatgtcggaaaaaggagcaaaggcactgattgaccgggtgaagcaggagctggaagaccatgaagcatgatcttcctttagagggaaagaaagtgctcgtcacccgcaataaagcgcaagcccaatcctttagggaaaaggtggaggctttgggcggagaagctgttttaacgtcattgatttcgtttcggcccgcccttccgccagaggcggcccagcgctttcaagcggatcttgaaagcgcggactggcttgtttttacaagcgtgaacggggcaaaattctttttttcttatttaaaggacgccggggccagtgctcctctcgcgtccgaggcgaaggttgctgcagtcggtgaaaaaacagcccggtatttgcgcgacaggggtctttctgtcgatctgatgccggagttatacgtggctgaacatttggcggaggcacttaagcaaaatgccggacgtcatgacaaagtggtcgttttaaaagggaatttatcccgggacgtcatcaagaaaaccctctctcctctcggaattcaagtttcggaatggattttgtatgaaaccgtgcgtgatgaaaggggaattctggacctgaaggaagcagcaaagcacgcgtcttttgattttgtgacgtttaccagttcttcgacggtacatacattcatgtccattctgaaagaggagagcttagcgtgggccgaaaagaaccggacggcttttattacgatcgggcctttgacaaagaaggcgctgtcggactacggaattccatcatatatgccggacgtctatacaatcgacggaatgctgcgcgaaatgtgccgcatttcaagaaagggagaatgactaatggaagcatcatttcaaagacaccgccgcctgcggacgacagcaggtatgcggaaattagtaagggaaaccgagttaagagcatctgatttcatttatccgatatttgttaccgaggaagagaacgtcaaaagcgaagttccttctatgccgggcgtgtaccagctgtctttggaccgtttgaaagaggagatggaggaagtcgcaagcctcggcattcaatctgtgatcgtcttcggcgtgcctgagcacaaagatgatgtgggaagcggagcctatcacgatcacggcatcgtccaaaaagcgattgcacaaattaaacaggactttcctgaacttgtcgttatcgccgatacgtgcctatgcgagtacacggaccacggtcactgcggcctggtggaaaacggtgaaattttaaatgacgaatcgcttgttcttttggcaaaaaccgctgtcagccaagcccgtgcaggcgctgacattattgcgccgtcaaacatgatggacggtttcgttgccgctatcagggaagcgcttgatcaggaaggatttacaaatgtgccgatcatgtcgtacgctgtaaaatatgcgagcgctttttacggaccgttccgcgatgctgcgggaagcagtccgcagtttggcgaccgcaagacgtaccaaatggattatgccaaccgcagggaagctctccgggaggcaaaatccgatgtggaagaaggcgccgattttctgatcgtcaagccgacgctttcatatcttgatatcgtcagagaagtgaagaacgaatttaacctgcctgttgtcggatacaatgtgagcggggagtatgctatggtcaaagccgccgcccaaaacggatggattgaagaaaaagctcttgttctcgaaatgctgacaagcatgaagcgggctggcgccgatttgatcattacgtactttgcaaaagacgcggcaaaatggatttcggaataagaatttgaactgggggttttagaggatgcggagctatgagaagtctaaagcggcattcgaagaggcgcaacgagtcatgccgggcggggtgaacagcccggtcagagcctttaaatcagtcaacatggacccgatttttatggggcggggaaaaggatcaaaaatctatgatattgacggaaacgaatacatcgattatgtcctgtcatggggaccgcttattttgggccacagcaatgaaaaagtggtgaaagagattcaaaaggcggcagaacacgggacaagcttcggtgcgccgacagaactggaaaccgagcttgccgagcttgtcatcgaccgcgttccttccatagaaatcgtccggatggtgagctccggtacggaggcgacgatgagcgccttgcggctggcgcgcggatacacaggccgtaacaaaatcgtaaaatttgaaggctgctaccatggacacggtgattccctgctgattaaagcgggctcgggagtagcgacactcggcctccctgacagccccggagttccggaaagcattgcaaaaaacacgattaccgttccttacaatgatctggaaagcatgaaacttgtctttcaagaattcggagatgacattgcaggcgtcatcgttgaacctgtcgctggcaatatgggcgtcgtaccgccggttaaagggttcctcgaagggcttcgcgagctgactgagacgcatggcgccctgctgatatttgatgaagtgatgacaggattcagggtggattacaactgtgcccaaggctatttcggggtgacgcctgatttgacatgcctcggaaaagtgatcggcggcggtcttcctgtcggcgcttatggaggaaaggcggaaatcatggagaagatcgcgccgagcggtccgatctatcaggccgggacgctgtccggcaacccgcttgccatgacagccggacttgaaacgttgaaacagctgacccctgaatcctaccgggaattctcccgcaaagctgaccgcttggaaaaaggaatttctgaagctgcagagaaaaatggcattccgtgtacattcaacagggcggggtctatgatcggctttttcttcacaaatggaccggtcatcaattatgatacagcgaaacagtctgacctcggactgtttgccgaatattataaaggaatggccgatgaaggcgtgtttctgccgccttcacagtttgaagggctgttcttgtcaaccgctcatacggatgacgacattgagcatacgattaaagctgctgaacgcgtattcgaaagaatcagccgctccagataaagaaaagggctgccggacattgccggcggctcttttttgcatggtgccgaaaacggctgctgatttttctgttcatattctgcctgcttttcacatacatctttactgacatctaattttaaaaattaggtgaagggaggatatcagtttgccgcaaaacaatcgtttgcaattttctgtagaagagtcaatctgttttcaaaaaggacaggaagtatccgaattattatcgatttcattggatcctgacattactgttcaggaagtaaatgattatgtatccatacgagggtcattagagctgacaggcgaatacaacatagatcaaacccgggagtatgcagagctgcctgcgacaagccgatttgtagaagatgtaaagctgaaaggggacggcagcgcagagctgacgcattgtttcccagtggatatcaccatcccgaaagacaaagtcaatcatttaaacgacgtatttgtttttattgacgctttcgattatcagctgacagatgcgaggatgctgacgattcaggctgatttggcgattgaaggcctcttgaatgtgagcggtgaagcgggtgaagaagaaccgcgcactatgcctgcggccgtccatccggaagaggagctcgaacctgcctacagatcaccttcaaacgacgaagatcagggtgaagagaaagaatatttgatccagcttgacagaccttacgaagagcaggacgaagaacaggcggaagaacatgataccggtgaggaaacggttccgatttaccagtcgtttctcggaaacgacacagaggaagctaaaccgttttttacagcgtctttgtcggcggcagagcgtacgaagcgcgaaatagaaaatcaaaaagaagcctctcttgaacagccggaagaagaatataagctgaaaagagagaaagtggaagaggaaccggaagaatatgagctgaaaagagagaaagtggaagaggaaccggaagaatatgagctgaaaagagagaaagtggaagaggaaccggaagaatataagctgaaaagagagaaagtggaagaggaaccggaagaatatgagctgaaaagagaagaagcggaagaagagccggagctgtcgcacagctcttatcaacctcacgaggaactgaaagagaacccgttctacagtgttcctcctcttctgaaggaagaccagaatgacagggagcctgaggcttttgaggttgaggtgacacaggaagcagaagcgattgatgaagaagaggaagccgggcatacgattgaaatcccggaatattcgtttcatgagcagacggagcccgaagaagaaagagatgaaatgcaggcagcggatgaacaggaagtgtcagcaaaggaaaacgacaacgcactctatttgacaaagctgtttacaaagcagggagaggaggagtttactcgaatgaggatgtgcatcgttcagcaaaatgatacgattgatcttctgtgcgagcgctatgatattaacgtccagcagctcatccggatgaattccctttcccttgacgaggaattaaaagagggacagatcctttatataccggattatcaaaacagccatgcctaatgcattgataaaaatgtggtgaagccgatggaaggcatccagtctgttttaaatgagtacggtcttacgcctgaatatatggagtccgtcagttcaaaggtgtggaaagtgtatacggatcacggtgtatttgctctgaaaaaattggcggcttcaagaaacacccgcttcacggaacagatgatcatgctggaggaaaaaggctacaggcagttcgttcctgtctatcgaaaccgcacaggcgaatttttaacgcaagccggagaagatgtctgctatctcatgccctggcttactcttgaaagggaggaagagcgggatcaaaaacacgaatatatgtttaaagaaatcgctcttcttcaccagcggacggaaaaagagctcggcgtgaggcgggaagaaatactcggacactatgaacggacaaaacggaaatgggaacagcaaaaacagaaatatgaagcattcatcatgaaagcggaaaacgaatggtatatgtccccgttccagcttcaggcggccatgtatttcaaagagacgatatcagctgccgactttgcgatcgcccgccttgaagattggcatgaagccatgagagaaaaagagtctgccagaatggtcttaaaccacgggcacctgtccgttcggcattttctctataacgataccggaacgggttactttacgaactttgagaaagcgggacatgcgccgcctgcaaatgatctcatcgtattttttactagaatgtttaagacgaaccccgttatgtgcacggaatgtgtaaactggttttatacgtatcacaatgtctatcctttgcgggaggaagaaatcagcttattcctcagctatatggcttacccggggcctgtattcggcgtactgaaccgctacgaacatgagaaggggctcggggaaaaagaagcctgtacaaggcttttaaaggcgtactggcaaatgaaaaacgctgagccgcttgtgatgagcattcacgagacggaagaaaacagaaaactgcaggaagaaacagagtccccatcatcatgatgcggactttttttcgtgcttaaatccagtcaaggtgaaaggcgcacgcaaggaatatgagaatgcccaaaaggaggacatcaaatgtggtaggaaagatgatcgtgcggatgccctggaatatcgtaatcgggaggacgacttgaacagcaacaagcctgacttgcttcagccacggctggaatgaatatgtgttgaatttttttcgcatcttatgcctcctctccttttcgttacagcatcatatgaggaaaaggagcttgtgtgcatggcccaatctcgtataaaacaacagaaaaacggaaaagatgattgacgaaaatgaaaaagatttagtaatataagaaaaagaaaaagtacgtgctgaaaagtcaatgatcacccgctttgaatgggaagagtacaaaaacagacgcttgcagagagggaagccggttcgctgaaaggctcccagtcagtcttttttggaaggtcgcccaggagcgcaatttctcgaacaaaaaagtagagaaattcgggaaagtcccgttatcccatttaagtgcgtgaatgcgtttttttgcattcatgaaaaaaggtggtaccgcgagagagttctcttcgtccttttaacaggatcaagaggactcttttttattgttcagccgtttaatactgttggaggtttgaaaatggataatcaagaactgacgatgccgacaaaatacgatccgtctgcagttgaaaaagaccgatacgactattgggtgaacggcaaatttttcgaagcgaaaaacgatccagaaaaagaaccgtacaccgttgtcattcccccgccgaatgtgacgggtaagctgcacttggggcatgcttgggattccaccttgcaggatatcgtgacaagaatgaaacggatgcagggctatgacgtgctctggctgccgggtatggaccacgccggtattgcaacccaggcaaaagtagaagcgaagcttcgtgaagaaggaaaaacgcgctatgatctcggacgcgaaaaattccttgaagaaacatggaattggaaagaggaatatgccgattttattcgcagccagtgggcaaagctcggtctcggcctcgattattctagggagcggttcaccctcgatgaggggctttctaaagcggtgcgcgaagtatttgtaaagctttatgaaaaagggctgatttaccgcggagaatatatcattaactgggatccggcaaccaaaacggctttgtcagacatcgaagtcatctataaagacgtacaaggtgcgttctatcatatgcgatatccgctgaaagacggttcaggctcgattgaaattgcgacgacccgtccggaaacaatgctcggcgatacagcggttgcggtgcatccggaagacgagcggtacaaacacctaatcggaaaaacggtcattctgccgatcatgggcagagaaatcccgattgtcggagacgactatgtcgatatggaattcggttcaggcgccgtcaaaattacgcctgcccatgatccgaacgactttgaaatcggaaaccgccacaaccttgaacgcattctcgtcatgaatgaagacggcacgatgaatgacaatgcccttcaatataaaggcatggaccgttttgaatgccgcaagcagatcgtgaaagatcttcaggaagagggcgtgctgttcaagattgaagaacatacgcattcggtcggccacagcgaacgaagcggagcagtcgttgagccgtatttgtcaacacagtggttcgtgcaaatgcagccgcttgccgacgccgccatcgaattgcaaaaaagcgaaggcaaagtcaacttcgtccctgaccgttttgaaaaaacgtatctgcactggatggaaaatatccgcgactggtgcatttcccgccagctctggtggggccatcggattccggcatggtaccataaagaaaccggtgaaatctatgtcggcgttgaagcgccggaagatgcagaaaactgggagcaggacaaagacgttcttgatacatggttcagttccgctctttggccgttttcaacgatgggctggcctgatatcgatgaggaagatttcaagcgctactatccgacgaacgtccttgtcacaggctacgatattattttcttctgggtatcgagaatgatcttccaaggtatcgaatttaccggagaacgtccgtttaaagatgtcttgatccacgggctcatccgcgacgaccagggccgcaaaatgagcaaatcgctcggaaacggcgtcgatccgatggatgtaatcgacaagtacggagcggattcgctgcgctacttccttgcaacaggaagctctccgggtcaggatttacgcttcagctttgaaaaagtagagtcaacatggaattttgcgaacaagatttggaacgcatcaaggttcgctctgatgaacatggacggcatgacatacgaagagcttgacctgtcaggggaaaaatccgttgccgataagtggattttaacaaggttgaatgaaacgattgaaaccgtgacacagctggccgacaagtacgaattcggcgaggttggccgccatctctacaattttatctgggatgatttctgtgactggtacatcgaaatggctaaacttccgctttacggcgaagatgaagcggcgaagaagacaacccgctccattttagcgtatgtgctggatcaaacgatgcgcctcctgcatccgtttatgccgttcctgacggaagagatttggcagcatcttcctcacgaaggggaatccattacagtcgccaaatggcctgaggccgtcaaagaatatacggacaccgaggccgcggcggatatgaagcttctcgttgaagtcatccgcgccgtacggaacatccgcagcgaagttaacacgccgctcagcaagcagattgaactttatattaaaacgagcacgccggaaatcgctgaacgacttgaagaaaaccgtttgtacgtagaacgctttacgaatccgagccttcttcagatcggaacggatattcaagcggtcgataaagcgatgaccgctgtcgtatctggcgccgagctgatcttgccgctcgaaggtctgattaacattgacgaagaaatcagccgccttcaaaaagaactcgataagctgacgaaggaagttgaacgggttcagaagaaattaagcaatgaaggatttatgaaaaaagcacctgcacatgtcattgaagaagagcgggcgaaagaagccgattatacggcgaagcgtgaagctgtagaaaaaagaatcgccgaattgaaaaactgataacacgaaaaaggaggtgttttccaggtctttctaaagctgttggaaaacaccttcatcaattgaagggaaggaatgcgcttgttcaaaacgtttgatgaagcactcagctggattaacggaaggcttaaattcggcgtgaagccgggtttggaacgaatggaatggctgctgagaaagctcgggcaccccgagaaaaagctcaatgcggttcatgtcgccggaacaaacggaaaaggttcaacgatcgcttttctccgttcggtattaaatgaagccggttatacagcaggcaccttcacatcaccgtatatcatcacctttaacgaacggatcagcgttgacggcgccccgatctcagatgaagaatggacggcgctctttaatgaggtcgggcctcttgtccttgagcttgaaaaaaccgaattcggagccgccacagaatttgaaattattacggcatgcgcatttttatattttgctaaatacaggcggacagattttgttatttttgaaacgggcttaggcggccgtttggattcgacaaacgtcgtgaagccgatgttaacggtcatcacttcgatcggccatgaccatacggcgatattaggcggtacattgaaagagattgccgcggaaaaggcagggatcatcaaacgcggcgttcctgttatcacagccgttcatcagcatgaagcggctgaggtgataaagcgaaaggcgatggagacagaatctgcttttatatcccttcacgaggattgccagctgtacggggagctttcattgcctgagggagagcagttttcgttgaaaacaccgttacatcattatgaaggaattgaaacaagcctgatcggcacccatcagcggcaaaacgcgtctttggccatacttgcggccgaatggctgacagccgaaaaacatgcggcgatcggcgaaaaagagctgaaacgcggcattcgtaacgcgggatggcccggccggtttgagaaggtattgaacaagcctcttgtttatatcgacggcgctcataacaaagaagggatggagcggctggccgagacgatctcctcccacttcgccgggcggaatattcacgtatgcttcagcgctcttaaagataagccgtacagagacatgatccgcaaaatcgagtcgtttgcgtcatcgattcacttcacatcctttgatttcccgagggcggaatccgctcaaaagctgtttgagcaaagtaccgctgattataaaacatttgatgaagacatcgcctctgttttccggtatatcgaagaaaaagctgaagaggaaaaagcggtggtcgttatcaccgggtcgctttattttatttccgccgtcagggcagctttaactgaataaaacataaaaatgcgcttttggccaccggctgacggcgcatttttatgttttaggaaaagcggaggcgcttcatatttgctaaaataacagccgctaggcagcagcttttttcatgaaatttgattctgcgaggttgataacgatgttcatcttttacctttttacggcaggtttagtgctcggctctttttttaattcggccgggcgccgcatttctgaaaagatatcattgattgctccgcgttccctctgccgcgtctgcaaaaggcagctgggcttctcggagctgataccggttttgtcctatttgatgcagcgggggaggtgcaaaggatgtcaaaccccgctctcgatcgtgtatccggcagttgagctctccgccgccatcctgtttgcgtttgccggcatgcacgttgggcatgagggggagctggtgattgtgcttgctcttatatctctgcttttgatcgtctttgtatctgatgtgacacacatgatcattccggatgctgttctttgttttttcctgcctgtctttgccgtcggacgattccttgttcctctggaacagtggcactcaagtttgagcggtgcgatggccggcggtatgctgcccctcttgacgctgcttttgacgaaaggggggatcggctggggagacgtaaagctgtttgcggtaatcggcatggcgctcggcagccgcctcctcgttctcgcttttttcctctcggcagccgcaggaacggtgcttggtcttattgcactcctggcaggcaaactgaagaaaaatgaaccaatgccgtttgctcccgcgattctggccgggacgctgacgagctgcttctatggcgaaccaatgatcgagtggtaccttcaaacggcatggtggtgaaaaatttgacgaaacctttttgggcaagacgacaaaagtcttgttctttttttttgaggctgtgataaagtgtggacattaagagggacagcctttaggagaactcctccttccttctggcttccctctgccgagcgtatagagagcggccaagctgccgcctaaatcaatataaaacaattaacagaaagcgagggaagcatatgaaaaaacggaaaagcaagaaaaactcagctaaaaaagcgcccgaacaagacccgcttaaagtgatgatcaacggcagagaagagactatctacggaaatgaaaaagagttttccaacagaaatgaagaaaagaagtttaccttttcgaactgggaagaaaagagaaaggcagaacgggaaatatcggcttcaaaagaggacggcacacatgaaacaggtgaatttacatggacgccaccggacgaagaagaaaccgtctacaaagacgatcctaaagtggtggcgccttatcaaaagaaaaacgagcccaaaaacaaccgcaaaacgaaaacgtctcttacgtatcctgtgaagcgatttgccgcgaccatcgtctttgctgttttgctcgggacgggactcggtctgtttgcgctgaatctcgcaacgcataaagaaggagtgccggcttccggcagtcttggggcggatgctgaaaacggccagaccgttaaagccggtgactccggtgccgaggagaaaaagagcggagaaaaaaatagcggacaagcgggagaatcttttaacagcttcgccgttcaggccggaaagttttcgtctaaagaaggagcggatacgctggcctctcaaatcgcagacaaggggtatgccgccgtgtcgattgccaaggacgacgggttttatgtaatcgccggaataacgggagaaaagcagatgacatctgaacttggcaaaatattaatcgaaaacgattttgaagcgtggggcggaaaagagcttccggttgcaatcgagtccggtttgctggagccttttaaagaagcggctgagctgtcggcaaaagcgattctcggcgcggaggttacatctcaaaacatagccgatgtcaaagctcaacttgacggggcccaatcaaaaggctctgaagaggtaaagaagagcatactggaagccgtcaaccttctggagaaaccgaccgcagccaacggctggaagagccagcagctattgctgggccaaattaaataaatagaaaaccagcagacgtgctggtttttttattttcgcgatttttgtcattaaaaagttatttttctgaaattgtggcggcggcgttcttttggtaggataaaacaggtatctttttttcctatgcaaaaacctttgaaaggatggcttcttatgacccgacagctcatattggcttcacaatcaccccgcagaaaggaactcctcgatctcctgcagattccgtacagcatcgttacgagcaatgcggaagaaaaattaattcgaaacttttcaccagcagaaaacgtcaaatggttggcggaacaaaaagtgcgtgcagtagccgaacaatatcctgatgccgtcgtgcttggcgccgacaccattgtttattatgacggagcttatttgggcaagcccaaagatgccgaagatgcagaacggatgctgagcatgctttcgggacagacccattcagtgctcaccggcgtctgcattaaggacggcgaaagatgcgaaacattttttgaggaaaccgaagtctctttttggcctcttgaagaaaaggaaatcagcgcttacatcgctacgggagaaccgtttgataaagccggttcatacggaatacaaggaaaaggcgcgctttttgtcaaacagataaaaggagactattatacagttgtgggccttccgatttccaaaacgatgagaatgctgaaaacgtttgatctccactccttttgatgtaccgaacgagaagggaatcaaaagggagggtttatcataagcgatctgccattgaaattaaaagattttcctgatgaagaaaggccaagggagcgccttctcaacacaggcgccgaaagtttgtcaaaccatgaactgcttgcgatactgctcagaaccggtacgaaaaaagaatcggttcttcagctttcaagccggctgcttcaaacgtttgacggcctccgtttgttaaaagaagcatccgccgaggagctttcaagcatttccgggatcggccgcgcaaaagccgtgcagattttggcggcccttgagcttggccggcgcattcacagtctggcttgcaaagaccgttatgtgattcgttttcccgaagatgcggccaattttttaatgggggatatgcgctttctctctcaggagcacttcgtatgtgtgtatctgaacacgaaaaaccaggtgatccacaagcgcacggtttttatagggagcctgaactcttcaatcgtccatccgagggaagtgtttaaagaagctttaaagcgctccgcagcttcattcatctgcgtccacaatcatccgtccggagatccggctccaagccgcgaagacatagaagttacacagcgccttcacgagtccggacagctgctcggaatcgaattgctcgatcatatcatcatcggtgatcaaaaatttgtgagcttaaaagaaaaaggatatttgtaacactttttttttcattaaattaagctataatagaatttatgggtttttgcttaggaatattgttttaagaaaggaagatacatacaaatgtttggaattggtgcgagagaccttggaatagatttaggaacggcgaatacgcttgtttttgtgaaaggtaaaggaattgtcgtcagggagccttctgtcgttgcactgcaaacagacacaaagcagattgtcgcagtcggaaatgatgcgaaaaacatgatcggacgtacgcccggcaatgtcgttgccctccgcccgatgaaggatggcgtaatcgctgattatgaaacaacagcgacaatgatgaagcattatattagcaaagcagttaaaaacaaaggcttatttgcgagaaagccgtatgtcatggtctgtgtcccgtcgggaattacggccgtcgagcagcgtgcggttatcgacgccacgcgccaggccggagcgagagatgcatatccgattgaagaaccgtttgcagcggcgatcggtgcaaaccttcctgtttgggagccgactggaagcatggtggtcgacatcggaggcggaacgaccgaagtcgcgattatttccctcggcggcatcgtcacatcccagtctatccgcgttgccggagatgaaatggatgaagcaatcattacttatattagaaaaacatataacttgatgatcggtgaccggactgcagaagcgatcaaacttgaaatcggttctgccgaagcttctgaaaacggagaaagcatggagatccgcggccgcgatcttttaacaggcctgccgaaaacgattgaaatcactgaaaaagaaattacagcggctcttcgcgacactgtgaccgccattgtcgatgccgtaaaaaatacgcttgaaaaaactccgcctgaactcgcggctgatattatggaccgcggaatcgtccttacgggaggcggcgcactgctgcgccacctggacaaagtcatcagcgaagaaacgaaaatgccggttttaattgcggaagaccctcttgactgtgtagcgatcggaacaggtaaagctctcgagcaaattcatctatttaaaggcaaaaattaaggacacagggaatagaagaggtgtataatcatgccgcagttttttacaaataaacggttgatgcttttactcctttgtatcatcattttagtggcaatgattggattttcgttaaagaatgaccggaatgcaacttggcccgaaaaatttattggcgatacaactggtgtattccagacgatttttcatacgcccgctcaattttttgcgggcttctttgaaaatatcgaagacttaaaaaatacgtacagcgaaaatgagcgcctgcggaaaaagctcgacggccagacacaatacgaggcaaagctgcaggagcttgaaaatgaaaataagtctttaagaaaagagctcggccatctgaaatcaattaaagactacacgccgattctggcgaccgttatcgccagaaatcccgataagtatgagtggtggaacctgattacgatcaacaaaggttcaaagcacggcgttgagaaggatatggcggtaacagatgaaaacggcaacttgatcggaaaaatcaaaagcacaaaagtgaacaatttcacttccaccgtccagcttttaagcgcaacagacagaaacaacagaatctccacagttatcgctgcagataaaggcaagaaaacggtgaacggaatcatcaacggctacgactcagataaaaaggcgctttccatggaaatcatcgagcctgatgaagacagggaagtgaaaaaaggtgacctcgtcgaaacttccggtgcgggcggcgtttttcctaaaggcctgacaatcggaaaagtgacagaggttgaaccagattcctacggtttgacgaaaatcgcttatgtagagccggcagccgatatgtataaccttgataacgtcatcgtcgtcgacagaacgcttgatacggtggatgtcgacaagatggacgatgaggaggaagggtcgtgaaacgcttccttcttcccgtcgtcatgatgtttgttttagtatctgacagcgtctatgcggattttgtcaacttgccttttgtgacggaagaacagcagctcatcccgcgttttctgctgcttgtcttagtttttatgacggcttatgtcaatcagccttttgccattacatatggatttattttcggactgttatatgatattaattacaccgaccttttaggtgtatatatgtttggttttgccggtatttgctatttatcgtcaaaagcgttcaaagtattgcagacaaacgcgctggtcgtcatttttatttcgctgctcgccgtctgtgttcttgaattttaccaatatggcgtgcagatgctgatacgtccggaaattatgccgttccatcaatttgtgctcggcaggctcctgcccacgcttgcgctgaacgccgttggcggccttctgctcatttacccgttcaaatggttttttaccagtcttaagaaagagctgaggaatgagtaaaaagaggattttatgagccgatgtcgaaaagagtatgatgttgaggtgaacaccgtgaagacccaaaagcagcaatacgtaacaattaaaggaacgaaaaatggattgacgcttcatcttgatgacacatgctcttttgaagaattattgtacggtcttcaggatatgctgtcactcgaacattatatggatggaaaaggccagaaaatcaatgttctcgttaagctcggccaccgctatgtgaccgaggagcaagaacagatcctgaccgatgtgatcactgagaaacaaaatctgttcatccactccattgaaagtgaagtcatgaccaaagatgaagcaaaccgcttaaaagcggaaagcgaaattatttctgtcgctaagattgtccgttccgggcaagtccttgaaacggagggtgatttgcttctcattggggatgtgaatccgggaggaatggtgaaagccggagggaatattttcatcctcggctcattaagagggattgcccacgccggttttaatggaaataaacgagctgttattgcggcttcggatatgagaccgactcaattgcgtatcaatcatgtgctcaatcgctccccagacaacatccaagaagggaacgacatggaatgtgcttatttagatgaaaatgagaatatggtcattgaccgccttcagcaattagctcatttaagacctagtttaacaaggcttgagggaggaatgtaaaattgggtgaagctatcgtaataacctcggggaaaggcggagtaggcaaaacgacgacgtccgcaaatcttggcaccgccttggccattttggggaaacgggtatgtctcgttgacacggatatcggcctgcgcaatcttgatgttgtcatgggccttgaaaatagaatcatatatgatttggtggatgtcgttgaggaacgatgcaaaatccatcaggcgcttgtgaaagataagcgctttgatgatttgctttatttgctgccggccgctcagacaagcgataagtcggctgttttgcccgagcagatggtcaagctgatccagcagctcaaacaagacttcgactacattgtcattgactgccctgcagggattgagcaaggttataaaaatgcggtctcgggcgcagacaaggcgattgtcgtgacaacaccggaaatctccgctgttcgtgacgctgaccggatcatcggcctgcttgaaaaggaagaaaatattgagccgccgagacttgtcgtcaaccggatccgcaaccacttaatgaaaaacggcgatacgctggatgttgatgaagtcattcagcacttgtcgatcgaactgatcggtattgttgcggatgatgatgaagtgattaaagcttccaataacggggagcctgtcgtcatggacccgaataataaagcttcaatcgcataccggaacatcgcccgccgcgtgctgggcgaatctgtgcctttacagtcgtttgaagaagaaaataaaggcgttttcgcaaagattaaatcatttttcggcgtacgcgcttaactgcaaaaagcaatctccaaagcgagattgctttttttgcagttttattgatcgttttctactttatgctttagcaaggaaagcttattgtcccaatacatgtcgaagtaggcgagccactgctgcagctcggcgagaggttcgggatgaagcctgtacagtttttctctgcccgcttttctcccgctgactaggcctgcttcggacaaaactctgagatgctttgaaacagccgtccggctcatcgggaaatggctgctgatatctgtgacaggcaattctttgccggcgaggagctccagcatttttcgccgggagggatcggaaacggcttggaacacatcatgttttgcggcggatgtcactagccctcaactgcctgacgcagcttttgattgacgattgtttcccagccgccattcatccgattgcggacatccgcttgcttttctcccgcttttgaaaccgtttcttccggcgcaccccatcctgaatgaatcagggtaaattcggttttttctgcagaaagctctttcaattcaaatgtgacgatccatcccgacgtatcccagctgaaagcgagtcgatgcggcgcatcaagctcgatcactttgcacggggaggggccgaaaggagactgcagggtgaattcgcagccgatctccgggcggaaatcattaggcataaaccaggcggcgatgccttcactggtggcgacggcctcccacactttttctatcgatgcgtgaaaaacagcctgtttatgtatatcaggcactagttgattgctcataatagacctcctagaaaaaagtaaaaccaaatggtttcctttctattatatgaaaccttttagttttatgtcaatgttccgtcataattccctgggacaaggcatatcattgaacaaacgaacctgaatgtaaaggatgagggttatgagtcatagagcagatgggattcgaaaaagaatggccaggaaaagaaagcggaaaacaccggacaaacagcccttttcatcagacggcaaaaagcggccgctcaagccgcctgcatggacagccttttcggaagatgaaaaaggaggagacttccctccgcctgaaggaagttccctgctgataaacgggaagcacccgcttgtcaaggcggatgcgctcatcttgaaatgtcttctgtcggcatgccttgttcttgtgtccgccattgcctacaaaggccagtttgaacccgcaaaccaaatcaaaccggttatcagccaggtgtttactgaagagttccaatttgcggccctccagaattggtatgaatccaagttcggcgatcccctcgcattctttcagccgaaaggcgccaaaccgtccggccaggtcgaggtgaatcaggatctcgctgtacctgccgtaggaaaggttcaggagaaattctcagggcagggcattaaggtagaaacagaagacgaaacgatccgcagcatgaaggaaggctatgtcattgaagtggacaaaaatccggaaacaggcctgacggtggtcttgcagcatgcggacaacagctatacctactacggccagctgaaaaaagcggatgtcgctttatacgattatatagataaaggaacgaagctcggaacgattgagcaggataaaaatcaaaaaggcatctattactttgcgatcaaacaaggagaggaatttgttgatccgatacaggtgatcacatttgagtaaatggacggagctcttcaccaagcttcacattcatccgctgctgtggcttgtcatggcgatcggtatcatgacaggacatattaaagcgctgttttgtttaatgatcattattttgatccacgagcttggccacgctgctgctgccgtttatttttcatggagaattaaaggcattttcctgctgccttttggaggaacgctggaagtcgatgaacacggcaacagaccgttaaaggaagagcttgccgtcatcgccgcggggcctgttcagcacatttggcttcaatttgcagcctggcttttggcggtcaattcgctcatcagccctcatatatttgaaacgtttactttttacaatctgaccatcctcttgataaatctgtttcctatttggccgcttgacggcgggaagctgctgtttctgctgttttcaaaacaccttccgtatcagaaagcgcagcggatgatgctggctgtatcgtgcttttgctgcgctgttctaatcgcggcgactctgctggtctccccgtcgcagctgagcgcttgggtgcttctcgtatttttggctgcatccctttaccaggaatatcgcaatcggcattacgcccatatccgttttttgcttgagcgctactatggaaatgagagggaagtgcggcgactcgcaccgatcacggtgtgcgccgaacagcagatttatgaggtcatgctcatgtttaaaaggggctgcaaacacccgatcattattgagaaggacggacaaaaactgagccagctggatgaaaatgaagttctccacgcttattttacagacaagcgcacgacttcctcaatggaagatctgcttctggtttattgaccatccttctaaaagacattgacactcgggctcttttctggtatattttttaatgttatggatgtagcacccgtgctacaaccgctcagcacaggcgttaagtgctttcttagccccctgtgactggcgagtcttagtttattaggaggtgcagagatgtacgcaattattcaaacaggcggaaaacaaatcaaagttgaagaaggccaaactgtatacgtcgaaaagcttgctgctgaagccggcgaaacagttacttttgacaacgtattgtttgtcggcggtgaaaatgttaaagttggcagccctacggttgaaggtgctacggtaacaggcaaagttgaaaaacaaggccgcgctaaaaaaattaccgtatttaagtacaagccgaagaaaaaccaacacaaaaaacaaggtcatcgtcaaccttacactaaagttgttatcgaaaaaatcaacgcttaaggcgtgtatgatatgattcatgcaaagattacaagatcccgatcgaacaaagacatcttgggctttgaaatgtcgggacatgcgaattttgctgaacatggtcaggatctcgtttgcgcaggggcgtcggcggtcgcctttggagccgtcaatgccgtaatgaagctgacgggcattgagccggtcattgacctcggggaagacggcgggtttttatctttccgcttcccggacggtacggatcgtgaggcttttgaaaaggcgcagctccttctcgaaggcatgatcgtctcccttgacacgatcgaacgagactacaaaggttacttaaaagtaacgacgaacaaaatataggaggtgagctacatgctaagattagatcttcagttttttgcatctaaaaaaggagtaggttcaacgaaaaacggacgtgactctgaggcgaagcgcctaggtgctaaacgtgcagacggtcaattcgtatctggcggttcaatcctttatcgtcagcgcggaacaaaaatctatccaggtgaaaacgttgggcgcggcggagatgacactctatatgcaaaagtcgacggaactgttaaattcgaacgtttcggccgtaaccgcaaaaaagtgagcgtatatcctgtagcctaacctttaaacgaaactccggtcgttctgaccggagttttttacattcagcaccatgacttgcttaaaacaccttcccgacgcctaaataaggccgggtttccgctctgattctgcttcgttaaagtatataaacgtgtttcatttatactgccttctctgttataattcaaagtacaaactgaatcagactcctaaaagagagaccaaacgattgggagtgccaaaatggaagaaacttcgaaaaaacgagaaaagaatatggacgataaggctttgacccatgagcttatccatctgctcagccactcaaggcacgactggatgaataaactgcaattgattaaaggaaacttaacattaaaaaagtatgaccgcgtatttgaaattatcgatgaagtggtcatcgaagctcagcatgaatcaaagctttcaaaccttagaatcccgcgcgcggcgtatgagctgcttacatttaactggatggcccattcgctgacgcttgaatatgaggtgatcggtcaagtcaaggatttgtcagcttatgaagaaaggctcgtcgttctcatcagaaagctgtttgggatttttgacgatgccgttttgaaaggcagcgacaatcatctgacgatcacgctgcagacggacggtccggacgaccgcctcgtcatctttctcgatttccacggcgtattcacaaagctgaccggtatcaaagactttcatcattcactggccgacttttatgaaatcaagcggtttgatgtaacagaccgtgagtgcatcgccgaaattcatatcaagtaaagcggttttttaggaatagaacggaggacattatgtttgttgatcaggtgaaaatatacgtaaaaggcggagacggaggcaacggtatggttgctttccgccgcgaaaaatatgtgccaaaaggaggccctgccggaggtgacggcggaaaaggcggagacgtcgttttcaaagttgacgaaggtctcagcacgctgatggattttagatatcaaagacattttaaggcagcgcgcggagaacacggcatgtctaaaaaccagcacggccgaaatgccgaagacatggttgtgaaagtcccgcccggcacggttgtcattgacgatgatacaaaacaggtcatcgctgatttaacggagcacggacaggaagccgtcatcgcaaaagggggacgcggcggacggggcaatacacgttttgcgacgcctgccaacccggcgccgcagctttctgaaaacggcgaacccggcaaggagcgctatattgttctcgagctgaaagttttggcagatgtcggtcttgtcggcttcccaagcgtcggaaaatcaacgctcctgtctgtcgtgtcttcggccaagccgaaaattgccgattaccactttacaacgctgaacccgaatctcggaatggtcgaaacggaagacggccgcagctttgtaatggcggatcttccgggactgattgagggggcgcacgaaggagttggcctcggacaccaattcctcaggcatatcgaaagaacgcgcgtcatcgtgcacgttattgacatgtcgggtcttgaagggcgcgacccgtatgaagattatgtgaccattaataaagagcttgaacagtataatctcaggctgacagaacgtcctcaaattattgtcgccaataaaatggatatgccggatgcggaagaaaatctgaaggctttcaaagaaaagctcacagatgattatcctgtttttccaatcagcgcggtgaccagacaaggcttgagggatctgctgtttgaaattgccgaccgtttggaaacgacgccggaattcccgctctacgacgaagaagacatggctgaaaacagagtcatgtataagcttgaggatgaggaagcgccgtttgagatcagccgtgatcctgacggcaccttcgtgctcagcggagccaagcttgaacgcttatttaaaatgacggacttttcaagagatgagtctgttaagcgttttgccagacagcttcgcggaatgggcgtcgatgatgcgcttcgggcccgcggtgcaaaagacggggatacgatccgtcttctcgaatttgaatttgaatttatcgactgatcataccggagagtttgccaagcaagctctccgacttttagctgaaaggaacgcccttcctttcgcaggatcaatgtaaaggaatcagggtttttaaaaggagagaaaagtctgtgaaagaggagaccttttatcttgtcagggaagacgtgctgccggaggcaatgcggaaaacacttgaggtcaaaaagctgattgagcggaaaaaagcggaatctgtagctgaagccgtacaaaaggtagatttgagccgaagcgctttttataagtacagagatgcggtttttcctttttatacgatggtcaaggaacagattatcacgcttttttttcatttggaggaccgctcaggaacgctgtcccatctgctgcaagtggtagctgaatcgggctgcaatgtgctgtcgatccaccagaccatccctcttcaaggaagagcgaatgtcacgctctctgtcagtacgagaggcatggatgaaaatatcgatttgctgatgaacaaattaagaaagctggaattcgtagaaaaggtcgaaatactaggttcgggcgcttaagggagagaatgacatatatcatgagtatgagagtaggttatttaggtccagaagcaacttttacgcaccttgccgtctgctcctgcttttcagatgcagaccagcaagcatttaacacgataccggcctgcatggatgcggcgatgaacggggagatcgatctggctgtcgtcccgcttgaaaatgcgattgaaggatcggtgaatctgacaatagactacttaattcacgaacagcctctttatattgtcggagaaatcaccgctcccatccgtcagcatttgcttgtgcatcctaccagaaaagaggcttgggaagacattcagaaggtttattcccattcccatgccatcgcgcaatgccataaatttttgcacagccggttccgctccattccgtttgaatatgcgacatccaccggagcagctgcaaaatacgtgagcgaaaatccggaagagaacatcggcgtgatcgccaatgaaatggcagcagatacttacggattagacatcgtcaaaagagatgtgcatgactatgaatacaatcacacgagatttgtgatgcttcatccggatcgcgaggcatcccctccggtcaaccctcaactcaagggaagaccgaaaacgactttgctggtgacccttccttcggacagatcgggagctctccaccaagtgctgtcggctttcgcctggagaaatttgaatctttctaaaattgaatcgcggccgacaaaaaccggtctcggcaattatttcttcattattgatattgaaatggccctggatgacgtgctgattccaggtgcaatagctgagcttgaagctttgggctgcaaggtgaaaatgctcggtgcctacaacgcatatacactataaaagaaaggtcctttgcgctgataacggcaaaggaccttttcttttattcgggaatgaggatgcccgctttttgcagggcgccgcaagcttgttcgatcttctcttcatcatctgcctccaatgtgtggagatggatgccgtttgtcagctgagacagataagcggcgtttgtcgaagagatttttttgacgaaatccgcgacttcttttcttgtgctgaccctgatcgaagctgttaagtctccgtagaccggatgttcaatcgttacatctttaaccgttacgccaaagtcgacgatcagattcagctcttcttccgttttttcgggttcgtggtcacaggcgatgatccgctgaaccggctgttttttgccgagggctgaccgcaaatacatgtacccttggcttgttgcgatgatcggttcgttttttgcttttaataaagaaatatcctgtacgatgacctgccgtgaaacagatgctcttttggccagctcgcttcctgtaagcggagcctctgactccttcagccaagccagcagctgctggcgccgctcagctcccgtaagttttaatccgtctgtcaatccgatggtctcctttctcattcatcatatcttcaagaacgtccaacagcctatcaacatgttcgcttgtcgtatcgcatccgaatgaaatccggacgaattgaagcgcgagctccctagggatcaaaagggctttcatcgtattcgaaggctcatgatagcccgctgaacacgcgcttccggtagaaatgcaaattcctctccgattacattccagcatagtatattgtccttcaaaggaatgaaaaaaacaacctataatatgcggcagaacatgcgaatttgccgaatcgggcacagcaagggagacgggaagcttccggtcttttactccttccagaaaacctgcgcgcagctcctggaatttgagatgcgcggcatccatgcggtttattgtcgactctgcagcggtaatgaaagcgccgattccggggacattgacggtgccgcttttaaagccgttttcatgcaaagtgcccgggtagacgggtttccagtttacacccggccgaatatagacagccccaactccttttgggccgtatactttgtggcttgagaccgataaggcatcagcgccgagctcatcaatgcggaccggaatcttggcaaatgtctgtacgcagtcgctgtgcaagagcacgtcccgcttatgcaggtaagccgagagctttgccagaggctggatgacgcctgtttctgaattggcatgctgaatcgaaaccagacccgtatccgggcggaggtgccgttcaagtatatcccttgtaatgatgcctgaagcattcggcttcatcaagtcgacatcaaatcccagcatctcgagatgccgtttcaaaatatggatcgactgatgctccatttctgtcattaaaaagcgctttttcccggcgggaagtccatttaagatggagtgaatcgctaaaaagttggcttcggtgcctccgctcgtaaaataaacgccttcttcttctccggataaaagttctgccatcctttggcggcagcagcgcaaaatgttttcggctttccctcctgcatcgtgcagactgctcgaatttccgtatacgtctgtgctaagtttttgaaacgcgtccaaggcttcttttgatgccggtgtcgtcgctgcataatcaagataaatcacggcgctcgtctcccattctttataaaaaatacttgagtttattttatcgatgtgtaaatataggtgtcaagacacatgtaaacttacaggaggagtcgacatgtctcatcagacgattattgttgtcggagcaggtgccgcagcgttgtcttttgctgcatccattccgccgtcttatgaagtggttgtgatgacaaaagcatctgtaaaagacagcaattcaaccctcgctcagggaggaattgcatctgctgtattgcctcgcgattcctggtcgcttcatgcggacgacacgttgtatgccgggtgcggccacaatcaaatcgaagcggtccatgatgccattaaagacggacagcgccttgttgatgagctgatccttcagcatttcccttttgatactgacgaatcaggaaagctgagcctcggaaaagaaggcgcgcattcggtgaacagaattttgcatgccgggggagacgcaacaggacaggagttgatccggcacttaatcggacggctcggtccgcacgtcgtgctgaaagaatacgaaacggcggcggatttatggattgaagacggacgctgctgtggcgtctggacgaaagacagccgtgggaagacgtttctcagaaaagccgattttgtcgtgctggcggcaggaggctgcggaaatctatttcaaatcaacacgaataaccgttctgtgacaagcgatgcgatttctttggcgtatcgggcaggagcagagctcgcagacttggaattcgttcaatttcatcctacattgcttgtcaaagacgggcgcgcgcacggacttgtttcagaagctgtgcgcggagaaggtgctgtgttgattgatgaaaacggacagcgggtgatggaaggcatacattctttgctggatttagcgccgcgggacgttgtatctcgggcgatacaccaaaagcttgcctgcggaagcagcgtatttttagatatttcccgcatatcagactttaaaagccgcttccctacgatttcttctctttgcgaaaaagccggtatttccattgaagagggccggattccggtttcaccgggcatgcattttttaatggggggcgtttctgtgaataaatggggagaaacggctgttccaaacctttttgtgatcggggaagccgcttgcaccggctttcacggtgccaaccgtctggcaagcaattctctcttggaatgcatcgtcttcggaaggagagcggcggagcggattcaagcctgccaaaaaccggagcctgtcagaggccaatctcctcagcctgagaatgtgacgtattctgttcctttgacagatgtgaaggatattcagaaacaaatgacagattatgcggcgatcgtgcggacggaggatgaattgacgaaggtgaaagaatggcttgagcgaatgccggttcaaatcgtaaatgtgaaagaaatcacaatagaacagctcgagctagctcatttatggcagactgccaaacagatgacggcctcggcactgcttcgtacagaaagcaggggcggccattaccgttcggattgtccggcgcctgatgataaaaactggcacggcaagcaaatcgttcacacaaaaggcgggatcaagatcagacaaaacgaagggattgtgaaatatgcagcggttcatacttaggaacatgcttaaggaatttttcaaggaagatatcggccggggggatctcacttcagaagccgtttttgatgacaatcatcaatgcgaagctgtcatcacagcgaaggatgacggcttgtttgcaggagaattagtgattctggaaggctttcggctgcttgatgaaacgatcgccgtccacatgctgaaaacagatggcgaagcggttcgtaaaggggaaacgatcgcgcgactcaaaggccgtgcagcttccctcatgaccggtgaacgggttgtgctgaatctcattcaaagaatgtccgggatcgccacattaacaaagcagtccattatcaggctgaatgatccgaatatcgcgatttgcgatacgagaaagacgaccccgggcctgcgcatccttgaaaaatacgcggtcaaaaccggcgggggcagcaatcaccgctttggattggacggcggcatcatgattaaagacaaccatattgccgcctgcggctcgatttcaaaagcggttgaaaaagcgcggtcagcgtgcggccatatggtcaagatcgaagtggagatcgaatctgaacaagagcttcatgaagcgattgaggccggcgccgatatcattatgttcgacaattgcccgcccgagacggtgaaagcatttgctgaaatgacacccgccggcattataacggaggcttcaggcggaatttcatttgaaaatctccccgcttacaggggaacaggggtgcactgtatttcattgggctacttgactcattcggcgaaaagccttgatatcagcatgaatgttgatctgaaaaaataagcgggattggagagggtacagatgtctattttaaaagtgattcatgacaggaacgccggcatgatgccggaggtgtataaagaattgactgaggaagaaatggccggaaggattttgaaaatcaaaaagaaattcggagcaaggctgtttatcccggggcatcactaccaaaaagacgaagtgattcaatttgcggacgcgacgggcgattcgctccagctggcacaggtcgcccaaaaaaataaaaaagcggaatatatcgtgttctgcggcgtacattttatggcggaaacagccgatatgctcacttcggacgaacagattgtcgttttgccggacatgcgcgcaggctgttcgatggccgatatggccaatatgcggcagacaaatcgcgcctgggaagagctgacgaagctgtttggcgatacggtcattcccctcacatatgtcaattcgacagctgaaattaaggcttttgtgggaagaaacggaggagcgtccgtgacatcctcaaatgcggcgcgcatgttgacatgggcgctatcgcaaaaggagaggattttatttcttccggatcagcacttgggacgcaacacggcatttgacctcggcattcctctaagcaggatggcggtatgggatccaattgcagaaaaacttgagtataacggcgatatgaaagacataataatcattttgtggaaggggcattgttcagttcacgaaaaatttaccgtggcgaatatcaaaagtgttaaagagcgggatccggacatcaatgttatcgttcatccggaatgcacccacgaagtcgttgcgctcagcgatttcagcggatctacaaaaaaaatcatcgactccattaatgaagcaaaaccggggagcaaatgggcgattggaacagagatgaaccttgtttcacgcatcattcaagaacatcctgataaacaaatcgaatcccttaaccctgatatgtgttcttgtttgacaatgaacagaatcgacatgccgcatttgctgtggtcgctggagcagatcgacaaaggtgaaccgacaggcgtgatcaaagtggatcaagatattgcaaaagatgccattcttgcgctgaatcggatgttaacgatccgttaactttttggagaacaagtttttatcataacccctccgctatgcgcataaatttgtggagaagcatatttgttattctcatctgttcgttcacgtttttgcataggaggggaaaacgttgaaaattcatattgtccaaaagggcgattctctggaaaaaatcgcggaaagatatgaagtggactttgaagaactgaaaaagctgaattcgcagctgagcaatccagacttgatcatgccgggcatgaaaatcaaagtaccgtcagggggagtgccggtcaaaaaagaagaacagctcaatatgcgaaaggaattaccgaaaaaacagcaggaacatccatttgcaaaagaaaagccgaaaagcaagcttgatgttgaagatataaaaccgaaagaaaagccttcggttccttatgttccgcctgtcccgaacatcggacaatcaagtttgcctgaaggcgacatttcgaatttgtatcaaagcgtcaatcagcttcatcagccgtacgtacctccaaaaccttatgaacatcaagagaaaggccccaacatgtataatccatggacaaatgaggaggaaaaccatatggaaaatgtcaattatccgaatgttccgcagccgccaaatgtcggtgcagcaggtgatgaaaataagcagtttcacggcatgccgaatgtagctgcagcgggatatcatcaccatccatatccttatccgttctatcctggaggctgctggattcctgtttcaccggtgctgcctggatcgggattttgccatccttggtatccatatcctgctcaaatgccttatatgcatcagcctagctatgtatctcctgctgaatatgacgatgatgacaacatggggcatgacaatgccggtcatcacggataccatcatcagccgatgactgccccggcatatgcgccttaccagccgttcccgggatttgcaccgccaaacgtcggtcacgccggggaccctaatatggcacacggcaaagaagatgactgcgggtgcgggccgggccaattcccgggaggttttccaggtgcggcgccatatggacagatgccgcaaatgggagctccgtacggtatggggggatacggacagcagcctgcagggggacagatgtttaacagaccggaagatgatgaagactgattcggaatgggacgatgatctatcgttccttttttattgtggaccgctataaacattttcatgctatttaacgggaatgtctataactgtcaagggtaactcttcgcatcccgcacatcctaaaaaagagcgcaatgctcaaattcagcggttttcacggggggtactaccattggacagcaagctgaaagtgttttcggggattttgcttttgacagcaggtctatctgcatgcggaacgaacgacgctatagataatggaaacaatacgcgcccgatcggatattattcaaatgatgcagatcgtaatgcaggtcttgataatgacggtcctgttacagaaatgcttgaaaacatgaacgggagaaacggtgcaacaaacgtaaacaatcgagcgggcaacggcaatcccgttccaacaggcgatggaacttacagccggggagacatgaattatcacaaccatttggtgaatacggcggatacaggctatgacagaccggaaaaccgtaaaatctcaaggaatatcactgggcgcgtcaacaaattgaattatgttgacgaaagccaggcagtcgtaacgaatgaaacggtcatcatcgccgtacggtctgataaaaggctgacaaataacgagagaactcaaattagaaaagcagccaaaacatttgccggagaccggaccgttcaagttgtcgaggacgacggcgcatttacaaggctgcgcgaaatgaacgatgatcctcagaacattagggatcgcggagacacgacgaataacaatttgaaccgcttgcggaaccaataacaagcagggaattgccggggattccccggcaattttttataagcgctcggccgattcctttacaaaaacggggaaaaccgtataaagtgtacatagagacgagaattattttggaggtagaaagttatggctggccattctaaatggaaaaatattcagagacgaaaaaatgcccaagatgctaaacgcggcaaaattttcatgaagcttgccaaagaaatatatgtagccgcgaaagaagggggaccagatcccgaatctaacgcaagtctgcgtctcgtcatcgataaagccaaaaatgcaaacatgccaaatgacaacatcgaccgcgccatcaaaaaagcttccggcagccaggatggaaaaagctatgaggaaattacgtatgagggctacggaccaagcggtgtggctgtcatggtcaaatgtttgacagataataaaaaccggacggcgacaagcgtcagaaccgctttcagcaaaaacggcggcagcttgggagaaacaggatgcgtttcttatatgttcgaccggaaaggatatattgcaatcgaacgtgaagatcttgagatagatgaagaagagtttatgcttgaggtcattgatgccggtgctgaggagcttgaaacgagcgaagagctgttcgagatttatacagagcccgaacagtttgaagaagtgaagaaaagcttggaggagcgcggctacaagctggcaacatccgaaattacaatggttccgcaaacctatgcagaagtcgatgaagcgcttcaggaaaaagtcgaaaagctcattgacgtgcttgaagatgatgacgatgtgcaggaagtgtatacgaacgttcattaaagaaaagggcgccgctcaagattagcggtgtccttttatgcttcatcaaaccatttagcagccgtatcaagctccagcggaaacatgatttgatttttgatcatatattgtgaaggaatctgtcatctatgagaggaggatctataaatggctgaacagcaaggaaatgagaagcctttcacggctatgggcgccggtgcgcaagatcaggaaaccgctcaaatcatcgagagagtcggcagccttatcaccggatttggcgaatccatctatgagctggtacagaaaaacagcggcatcgatctgagagaggctgacttcacaaaaagcgagaatgcggaactgaatcaagcgatccaaaatattatcagcgaatacattcaaaatctcaacaatctgaatgccgatctcagcggaaagatcggtgaatcgatccaaggcatcgtcacaagcaaagatcaaaaagacgcttaaatattggacagcatgataatattgtcggcaaagctgcattcagccttgtcgacaagttttttttatacatacgaaaattttgctgtaacggtcaaatgctttttttcatcccgcagcgccggcattcgcgcaaaaactgcccgtttttcacagagcttttaaaaagggtgtaatcgcaattgtcgcaccgtccgtggcggacatccaaatattgattgtaatcataaacttttgtcaggtcgtagccttttgtttcatattctgtttccatgttttatcacctgcacttttattgtcggttataggataacagaacgggggagaaaagaaaatataacatctgccggtggcggccgcagatgattctcacttttatcaaaccgtataccccgttcctgatagaatgcttcattctcaagctggatgggcttttgggaaaaacctgcaaccagaggagcccattcttatgagattttcttcttaaaatttatcgatcttttaaactaaagaaaaagtattgttttaataaaaatatttaaatttttattttttatcaaacttattcataattgaacgcgtcatgtctaaagcgtaaaataaatgtgtcacaaaaaagccaaatatacaatgaggcatggaggacatgcctataaatcgaaaggtagtgtaaaaggggaataaccaatgaagaaaaaagtactcatctacttggtgatcgcagcagtgatgataaatggtgtatacaggtggtccgaaaaaacaacccgggaaagctatcagatccaggccggggacaaatacaagaacttcaaggaattgcaggaaaacgaaaaaagcggctatgacattgattatcacgaaaaagcgggaagcgactgtttaatcttttcgccccatggaggaagaatagaaggcggagtgagcgagcttgtccgagcttttaatgatgattattcaacttatttattcgaaggaaaaaa
